United States Patent 10,695,415 (LIVE ATTENUATED ORAL VACCINE AGAINST SHIGELLOSIS AND TYPHOID FEVER) - sequence listing, part 15

SEQ ID NO: 5 - DNA, 4808964 bp, Artificial Sequence (residues 3,205,977-4,808,964 of 4,808,964)
  Ty21a-ABC-Sso, clone #20-25
gcttacgcgcgctggcgacggcctgtctcaactcctcttcggtcatgacgccgaagccggtatccgcgcgtccgcgcactgcgttttccagctcaataggggaaaccgttgacgtcccgagtttacctaccactacgcccgccgccgcattggcgaaataacacgcctcctccagggtatttcccgccgccagcgtcgccgccagcacgccgatcaccgtatcgcccgcaccggtaacatcataaacttcctgcgcctgcgtcggcatatgtagcggcgctttattcggttgcagcagcgtcattccctgttcggaacgcgtgaccaacagcgcggaaaggtcgtaatcggcaatgagcttcatgccgcgttcaaccagttcgtcttcgcttttacatttccccgcaaccgcctcgaattcagaaaggtttggcgtcagcagcgtggcgccgcggtaacgttcaaaatccgttcctttcggatcgatgagcaccggcacgcccgcctggcgcgctagggaaatcatagtctgcacgctggtcagagcgcctttggcataatcggacaataccagcgcgccgatcgatcccagcgcctggttgatacgctcatgcaacggctgcgggtccacgccctcaaagccttcttcaaaatcaagacgaatgagctgctgattacgtgatagtacgcgcagtttggtaatcgtcggatgcgtcggcacagaaacgaagtcgcacttcacattgacctccgccagcgttttgctcagcgcgcgcgcggcgtcatcaatacccgtcaggccgaccagacgggcgttcgctcccagagacgcaatgttcatcgccacgttcgccgcgccgcccggacgttcctcaacggtatttaccttaaccacgggcaccggcgcttccggtgaaatacggcaagtggggccataccaatagcgatccagcattacatcacccacaaccatgacgcctgcacgttcaaacgctggcagatttactttcattcctgtctcctgagagattcaaaatttgcgcgcgataatagcataattcaaacggctaccagccacttccgccagcttgcctgcaccagcgcgcgctctttgctaaaacatgtctgcgccacatgaccgggaagctcctgcaacgccaggtggtgcagttcatcacgcagtgtggtgtaggctaccgtcagcgcctgcgcttcgtgttcatccataatgccgttttgcgccagaagctccaggatgcgcacgttatcagaccagcgcgttaatttaggtttttcatgagcgtagcgcagtaccagatattgcgcgataaactcaatatccgtaataccgccttcatcagctttaatatcaaaacgatcgcgatgcttattgccgagatgcgcccgcattttctcgcgcatttcacgcacttcagtctgcaatgtcttaccgtcacgcgccgtcgtcatgatagtgcggcgcaccgcatcaaactgtgaggtaagctgcgggtcgccatataccacgcgagcgcgtaccaacgcctgatgttcccaggtccaggcttcatgctgctgataatcggcaaacgcgtccgctgaagtcaccagcattccagccgcgccagaggggcgtagacgcgcatccacctcatacaaaatgccggaggaggtgcgcgtactgaacagatgcataatgcgctgcgccaggcgcagataaaactgccgcccgtcgatttcgcgttcgccgttggtcatgacgtccatcggacagtcatgcaggaagatgagatccagatcggaactgtagcccagctcccatccgcccaacttgccataaccgacgaccgcaaacccccgcccctggcgttcgtccagatgcgctggctgaccataacgcgcaaccatttgcgtccacgcctgctgcaccacagcatcaatcatcgcctccgccagccatgtgaggtgatcgctcactttcatcaccggcagcgtaccggcaatatccgccgccgcaatccgcaaaagctgtgcctgtttaaactggcgtaatgcctccagttgttgttcttcgtcctcttccggcacgcgcagcaaatactggcgtaattcgtcgcggtaagcgtcggtagccgtcggctgataaagcgtgccggggtcgagcagttcatcaagcaacaacggataacgcgccagttggctcgctatcattggcgaagcggcgcagagcataatcaggtgtttcagcgcgccgggaaattcgctcagcagctccagataggtggtgcgagtgacaatccccgccagcaacggcgttatccgcgatagcgtaacagcggcgtcttcgcgggaacagacgtcagcaagcaggtgcggcatcagttggtccagcacctgccgcccgcgcgggccgatagggcgtttatccagttccttacggaagtcagcgataagggtcagaacctgtcgccgatcctcatcggctaaatgcgccagcactggcgtcgaatcatcctcctgtagcgcatcctgccatacttcacgccacggctctgaacgttcttcctcctgcggggtatcggcttcatcatcgccaattaattcgttgaatacgcggcgtacattagccatatgatccgtcagttcgccaacaagctgcggccagttctccgccttcattccccaggccagccgcgcccgattcagatcgtcggcaggcaacgtttgcgtctgttcgtcattgatgctttgcagcagattctccagacgacgtagaaaaagataggccacgcgtagttgcgccacgtcattctcaggcagcaaatgcagcgcagcgatagcatccagcgtcggcagtaacgaacgcgactgtagcgacggctcgcgtccgccgcggatcagctggaatacctgcacgataaactcaatttcccgaataccgcccgcgccaagtttaatgttgtctttcaaaccgcggcgtcgcacttcgcgggcgatcatccctttcatattacgtagcgactggatgacgctgaaatcgatatagcggcggaaaacgaaaggccgcagcatggcgcgtaattcacgagaccaggcgtcgtcgttatcgcccattagccgcgctttcaccatggcgtagcgttcccagtcgcgtccttgctcctgatagtaatcctccagcgcggcaaaactcagtaccagcgggccgctgtcgccaaacggtcgcaggcgcatgtctacccgatagacaaaaccatccattgtgggctgatccagcgctttgatcagccgctgcccgagacgcgtaaaaaactgggcgttatcgagttcacgacgcccgccccgggtctcgccatgttccggccaggcgaaaatcagatcgatatcagacgaaaaattcagttcgccgccgcccagcttgcccatgcctaaaatcagcagcggctgcggaacgccctgcgggttacagggggttccccattcgcggcaacaggcggcatacagccagtcgcgcgccccgacgatgagcgtctccgccagatggctcaactgttgtaaaatagtctcatcgtccaccagcgacagcgtctgtgcccaggcgatgcgtaccatgatgcgacgacgaaaaagcctcagctcacgcatcagcgaggcgtcgtcacagacacctgccaacgcctcctgtaaccagccagcgtaatgtcgccattcatcagcctgcggcgatgcggattccagttcggcaagccactccggatgcgctatcacgctatccagcgcaaaatcgctaaatgtaagcactgacttcgcctgcgcgctaagcgatgtctcagtaaatccttctggtaggcgctcaacaacggtctgccagtactgcgataagggtgaagagagcggcgtcatttaggggatatcctttaaataatgccggatggcggcgtttcgcctgatccggcctacaagtccgcataccgtaagcctgataagcgcagcgtcatcaggcgctttctacggttctgattatcgttttccgctgtgcaaccagaacggctgctggttgatggcctcattacggaaatgttcaatttcaatacgttgcccggtaataatggcgtgacgcaatccctgccagttttccagccatgcctgcgcgaccatcgcatcataatacccggccagcagtaaaacgctgtcgatatcgcgagtcaaacgcggcaactggtcgcgatacttatcacccagcggttgtccaaaaactttttttaattcagcagcatgacgagaaagatgaatgtcggcgaaacgcttaaaagaatcggccattttggcctgcgccttcgcgtccagaaatggctgccaggctttcgtcaccagccattccgtcaatgccagtttcgccatcgccgtttgcgtactataaacggctgtgacggcggacaccgcggatgtcatcgtcgcttccgcctgggtaagtagatcacgtaagtgagcgctcgctttacgtggaacaatgccaccaaaaagcattaaggcatggcgcactaatcccatagcatccagcacatgttctttcgccgactcgtcgccgcgcagccagagctcttcatggtactgccactgtgacaacgccagatccagcgaggcctccagcccttgctctaccgtagctttcgcggcagtccgcagaattgccgttggtgtattctctcgcggcgcattcccctgcgccaggtgataacctcgcgccgccttactcagactgccctgacgcaaaccggtttgcgacagcagttgcttcgccagttttaacacggcgcgcgtatcgccgcgaagcaactcaagctccagctcacaaattggttcggcaaactcgcccgcttttacgtcgccgagatcgagcgcaatttcaatcctgctgccgtcaacgtccagacaccatttttcccggtaaaaatcggtactgaacagcggctgtacgcttgatgccaggccgtcgggcaggttgccatccggccagacctccgccggaagttgcgtcagatccagcacgggttcgcttagcgcaacattgtattcgggtcgctggtgcagcccgcccgttacccggccggcaattttcatggtcatttcatagcgcccattttcaccacgaatacgcagccccatatcatggcggcgtagccagttatcaggcgtttcgaaatagatattcagcaactggctgggcgcatgatgctcgccgccgagcgtatgaagatgatttcgcagcgcatctacggcgtcgtgattgacgataaactttaattcgatttcctgagccatggccttgtacttatgggttatgtcacatctgggaagattcttggcgaacttacccgcattatttttgtcagtagatagtattttgcgccaaattgccatgcaacgagcaatttgacgggcgtaaaagtttgacgtagcggcaaaggcgacacagatgattccgattgatgtcgactgctttgcgtagcgacactgatgccgttactatcgttccactttctctgacaataacgacagcctgatgccaaaattacgcctgattggactaactttacttgcgcttagcgccaccgccgtctctcatgctgaagagacgcgttacgtttctgatgaactgaatacctgggtccgcagcggtccgggagataattatcgccttgtgggtaccgtcaacgccggcgaggaagtcacgctcttacagagcgatgccaactatggtcaaattaaagacagttctggtcgtactgcctggataccgttaaaagaactgaataccacgccaagcctgcgtacccgcgtgccggatctggaaaatcaggtcaaaacgttaaccgataaactcaacaatattgataccacgtggaatcagcgcaccgccgacatgcagcagaaagtggcgcaaagcgacagcgtcatcaacgggctaaaagaagagaaccagaagctgaaaaacgagctgattgtcgcgcagaaaaaagttagcgccgcgaatctgcaactggatgacaaacagcgcaccattattatgcagtggtttatgtatggcggcggcgtattgggtattggcttgctgttagggctggtgctgccgcatatgatcccaagccgtaaacgcaaagaccgctggatgaactaaatcgccttctctgcggcactgtcttatcattagaggatgatcgtttttaaaaggaaagtggcgtgaagatttatctggtcggtggtgcggttcgggatgcgttgttagggctaccggttaaagataaagattgggtcgttgtcggcgccacgccgcaggagatgcttgatgcgggctaccagcaggtaggccgtgattttcctgtgtttctccacccgcaaactcacgaagaatacgcgctggcgcgtaccgagcgtaaatccggttccggctacacgggtttcacctgctatgccgcgccggacgttaccctggaagccgacctccagcgtcgcgatctgaccattaatgctctggcgcgcgacgatgacggacagattatcgacccttaccacgggcgccgggatctggaggcgcgtctactgcgccatgtctctccggcgtttggcgaagatcccttgcgcgtattgcgcgtggcgcgttttgccgcccgttacgctcatcttagtttccgtatcgccgatgaaacactgacgctaatgcgcgaaatgaccgcggcaggcgagctggaacatctgacgccggaacgggtatggaaagagacggaaaatgcgcttaccacccgcaatccgcaggtttacttccaggtattgcgcgactgcggcgccctgcgcgtcctgtttccggaaatcgacgccctgtttggcgtacccgcgccggcaaagtggcatccggaaattgataccggagttcatacgttgatgacgctgtcgatggccgccatgctcagtccgcagcttgatgtccgtttcgccacgctttgtcatgatgtgggcaaaggcttaacgccgaaaaacctctggccgcgccatcatggccacggcccggtgggcgtgaaactggtcgaacagttatgccagcgtttgcgcgtccccaatgacctgcgtgatttagctaaactggtcgccgcgtaccacgatctgattcacacctttccgatactccagccgaaaacgatcgttaagctgtttgacgccattgatgcatggcgtaaaccgcagcgcgtcgagcagattgcgctgaccagcgaggccgatgtccgtggacgtaccggctttgaagcgtcggattacccgcaggggcgctggctgcgcgaagcctggcaggtggcccaagcggtaccaacgaaagaggtggtggaggccggatttaagggcattgagattcgcgaggagctgacgaagcgacgaattgcagcggtcgccaactggaaagagaagcgctgcccgaaccccgccagctaaacgccatccggcacgataaattgcctgatggcgctgcgcttatcagaccgacaaaactgttaggccggacaaggcggtacgccgccatccggcacggtcaatcatcagaagaagacaacgtaaacggcagccgccaccacaaagcggtaaatcgcaaacggaataaacgagatacgcttaatcagttgcaggaaggtcttgatggcgatcagcgccaccacaaacgccgtcacaaagcccaccgcgaacattggaatatccgctgcggtcaggaatgaccaacttttgtagagatccagaaccgttgcgcccatcatcatcggcacagccagtaagaacgagaactcggaggcggcgtaacggctgacgcccatcagcatcccaccggaaatggtcgctccggaacgcgagaagcccggccacagcgccagacactggaaacagccaatcataaacgcctgacgatacgtcatatcatccagccccggcgcgcgcggttctttcggcttcaggcactcggcggcaatcagcaacagaccgcctaccaccagcgcatacatcacgttaatcgggttaaatagcgacttgatcgtgtcatgaaagactaaccccagcaccaccgccggaatcatgcccagcaggatgtgaatcaacgttaatcgacctttactttcaccttcacgctgtagcgggcggccaaagtgaataccgatgagaccaaacaaccgccgccagaacatcaccacgaccgccagaatagatccaagttgaatcaccacttcgaatgtcttggccgtatcgccttcaaaccccagcagatgacccacaataatcatatggcccgtgctggataccggcaaaaactccgtcaatccttcgaccacacccaaaattgccgctatcagcagcgagtgcatatcgctcatcaataaacccctaaaatgaaaaacactgcaaaaatggatctcgcgttaagaccccatatataaccgtttggtttaaaaaatataaaattatttatttttatttcagattattgccacgctcaataattacccctacgttcgccgcgcgcgcgacggcgctaggcttgctcagtttgatgcgaacccacggagaattgaatcggctaagcagtagatccgccacctcttccgccacacgctcgaccagagcaaaacgcccgccttcaacatgatttatcaccgtgtcggcgatatccgcgtaacttagacaatctgcgacatcatcgcttttcgccgacttgcggttatcccatgccatttcgatatcgaacaccagtttttgctcgatagtctgttcccagtcgtaaacaccgatagtggtgattaccgaaagttgctctataaatacaatatccatcacgacctgcctgctttttggctaacccggataccacttccggcgaaatgtgcgtattatccacagaaatagtaaataaaacgacactttcaatacggaacagcttatgagtgcaatcgcgcctggaatgatcctcttcgcgtacctctgcggctcaatttccagtgccattctggtttgccgcatcgccgggctgcccgatccgcgagaaagcggctccggcaacccgggcgcgacgaacgtattacgaatcggtggcaagggagcggctgtcgcggtacttatttttgacatccttaaaggcatgttgcccgtctggggcgcgtatgcgttaggcgttacccctttctggctggggcttatcgctatcgccgcctgtctgggacatatctggccggtcttttttggctttaaaggcgggaaaggcgtagcaaccgcgtttggcgccattgcgcccatcggctgggatttaaccggcgtcatggcaggcacctggctgctgacggtcctgttaagcggttattcatcgttaggggcgattgtcagcgccttgattgcgccgttttacgtctggtggtttaaaccgcagttcactttcccggtgtcgatgctgtcatgtctcattttgctgcgccatcatgacaacatccagcgtctgtggcgtcgccaggagacgaaaatctggacgaagctgaaaaagaaacgccagaaagattgagctggaactgcgtctggaagagggcctcaaccgtctggggatcggcccacaagggttgaccggcaatagctcggtgataggcgtacatatcgaatccgccgcgcgtcacccttccaccattggcgtggttaggcgcgattttcggcctgattttcctggtgctgctgatcgtctccaggctgttgtggatgcccatcgttttgctgtaaatccgttggggcggcatgatgtcgccccctttttccgcttttacgccgccggcagctcggccagcggccagcgcggacgtaccgttacgccaagatccgccgtaacgcccgccttaaaccgcaccattccggcataggcgatcatcgccccgttgtcggtacaaaattccgggcgcgcatagaacacttcgccgcggcgtttttgcatcatttcggcaagcttcgcacgcagcgtgcggttagcgctgacgccgcccgccatgacaagacgcttaaaaccggtgctttccagcgcgcgcttgcacttgatcatcagcgtatccacgaccgcatcttcaaaagcgcgcgcgatatcagcgcgagtttgttcgtcgtcgccattactacgaatggtgttagcggcaaaggttttcagaccggaaaaactaaaatccagccccgggcgatcggtcatcgggcgcggaaagacaaaacgccccgccgtcccctgcgacgccattttcgacagcatcgggccgccaggataatccagccccaacaatttggcggttttatcaaacgcttcaccggcggcatcgtcaatcgactctcccagcagttcgtactgaccgattccggtcacgctaatgagctgcgtatgtccgccggagaccagcagcgccacaaacgggaaatccggagggttatcttccagcattggcgccagcagatgaccttccatatggtgtacaggaatggctggcacattccaggcaaatgccagcgaacgcccgacggttgcgccgaccagcagcgcgccgaccaagcccgggcctgcggtataggccaccgcgtcgatatcgctcgccgtcagagcggcttcttttaatgccgcctgaatcagcggcacggttttacgcacatgatcgcgggaagccagttcaggcactacgccgccgtaatcagcatgtaatttcacctgactatacaattggttggctaacagaccttttttgtcgtcgtaaatagcgatgccggtttcatcgcaagatgtttcaatacccagtacacgcatgacttgttttacctcgctctaataccgcgcagtgtaggtcgaatgcgggtggatgtataccctcagtcccgacttcgtgtatactccctccccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgacgaccgaacgtaagcgcgctaaagcttctgcagtgaaacgtcacgcgaagaaactggctcgcgaaaacgcacgccgtactcgtctgtactaatcttttgagagcgggctgctctcaattcagatcgagttgtagttgcaaggccgtgcttccgaaaggaatgcgcggcttgttttcgtttatgcattagcatatacacaaaatcattcatgctacgtccaggcggcaagagagcaagtccccggcgcttacgcaagtcagcgacaggggtgagcaaacgtagccaacactacggcagcctgaagaatgacgtgtataaaaggggcatatggctggacgaatcccacgcgtatttattaatgacctgctggcgagaaccgatatcgtcgatctgatcgacgtgcgcgtaaaactcaagaaacagggcaagaactatcacgcgtgttgtccattccataatgagaaaaccccttctttcaccgtaaacggtgaaaaacagttttatcactgctttggatgcggcgcgcatggcaatgcgatcgactttttgatgaattacgacaagctcgaatttgtcgaaaccgtcgaagaattagcggccatgcataacctggaaattccctatgaagcaggcaccgggcttagccagatagagcgccatcaacggcaaaacctctatcagttgatgaatggtctgaatgacttttatcagcagtcgcttacccatcctgcggcaaaacctgcgcgtgactatctgcaaaagcgcggtctgagcgctgaaattattcagcgtttcgccattggcttcgcgccgcctggttgggataacgcgttaaagcgcttcggtaataacagcgataacaaggcattgttgctggatgccggaatgctggtcaataacgagcagggcagcacttacgatcgtttccgtaatcgggtcatgttccctattcgggacaaacgcggcagggtgattggttttggcggtcgagttctggggaacgacacgccgaaataccttaactctccggaaacggacattttccataaaggccgccagctatatggtctttatgaggctcagcaatatagtgctgaaccgcaacgcttgcttgtggtcgaaggttatatggatgtcgtcgcactagcgcaatacgacattaactatgcggtcgcctcgctgggtacctcaaccacggcagaccatatgcatatgttattccgggcgacgaacaacgtaatttgctgttacgacggcgaccgggctggccgtgatgccgcctggagagcgctggaaacagcaatgccttatatgaccgacggtcggcaggtacgctttatgtttttacctgacggcgaagacccggatacgctggtgcgtaaagaaggcaaggcggcttttgaagcgcggatggagcaggcgcagccgctctctacgtttctgtttaatagcctcctgccgcaggtggatttaagctcgccggatggcagcacgcagttagccgcgctggcgctgccgctcattaatcaggtgcctggcgacacgcaccgtattcagctgcgccagacgttggggctgaagttaggcattttcgatgatagtcagcttgatcgtttagtgccaaaacaggcggaaagcggcgtttcccgcccggctccgcagctaaaacgcacgaccatgcgtatactgataggattactggtgcaaaatccggatctcgcgccgttagtgccgcccttagacgcgctggatcagaataagctgcctggacttggcttatttaaagaattggtcaaaacttgtttggctcagccaggtcttactaccggacaacttctggaactctaccgtggcacaaatgatgctgcgacccttgaaaaattatcgatgtgggacgatatagcagataaggcgattgccgaaaagacctttaccgactcactcaaccatatgtttgattcgctgctgcaactgcgacaagaagagctgatcgctcgcgatcgcactcacggtttaagcagcgaagaacgccgagagctctggacgttaaaccaggagctggccagaaaatgaatttaacggcttaaatgccgcatatcgttcgggaagcccccgacagccgcagtgagaggcagcggccaaaatataagtatgccctcgctttaaatgtcgacagctataccgtcgacaccaatcaaacgaataagtgtggataccgtcttatggagcaaaacccgcagtcacagctgaaacttcttgtcacccgtggtaaggagcaaggctatctgacctatgctgaggtcaatgaccatctgccggaagatatcgtcgattcagatcaaattgaagatatcatccaaatgatcaacgacatgggtattcaggtaatggaagaagcgcctgatgccgatgatctgctgctggctgaaaataccaccagcaccgatgaagatgcggaagaagctgctgcacaagttctgtccagtgttgagtctgaaatcggtcgtacgactgacccggtacgcatgtatatgcgtgaaatgggcactgttgaactgttgacccgggaaggcgaaatcgacatcgctaaacgtatcgaagacgggatcaaccaggttcaatgctccgttgccgaatacccggaagccattacctatctgctggaacagtacgatcgcgttgaggctgaagaggctcgtttgtccgatcttatcaccggctttgtcgatccgaacgcggaagaagagatggcgccgaccgcaactcacgtcggttctgaactctcccaggaagacctggatgatgacgaagacgaagatgaagaagacggcgacgatgacgccgccgatgacgacaacagcattgaccctgaactggcacgcgaaaaattcgctgaactgcgcgcgcaatacgtcgttacgcgcgacaccatcaaagcgaaaggccgcagccatgctgccgcgcaggaagagattctgaagctgtctgaagtgttcaaacagttccgtctggtaccgaagcaattcgactatctggtcaacagtatgcgcgtgatgatggatcgcgtgcgtactcaggaacgtctgatcatgaagctctgcgtcgagcagtgcaaaatgccgaagaagaactttatcacgctgtttaccggtaacgaaaccagcgaaacctggttcaatgccgctatcgcgatgaacaaaccgtggtcggaaaaactgcacgatgtcgcggaagaagtgcaacgctgcctgcaaaaactgcggcagatagaagaagagaccggtctgaccatcgaacaggtgaaagacatcaaccgtcgcatgtccatcggggaagcgaaagcccgccgtgcgaaaaaagagatggttgaagcgaacttgcgtctggttatttctatcgccaagaaatacaccaaccgaggtctgcagttcctcgatctgattcaggaaggcaacatcggtctgatgaaagcggtagataagttcgaataccgtcgtggttacaagttctccacctacgctacctggtggattcgtcaggcgatcacccgctctatcgccgaccaggcgcgcaccatccgtattccggtgcatatgattgagaccatcaacaagctcaaccgtatttctcgccagatgctgcaagagatgggccgcgagccaacgccggaagagctggctgaacggatgctgatgccggaagataaaattcgtaaggtgctgaaaatcgccaaagagcctatctccatggaaacgccgatcggcgacgatgaagattcgcatctgggtgatttcatcgaggatactaccctcgagctgccgctggactctgccaccaccgagagcctgcgcgccgccactcacgacgttttggctggcctgaccgctcgtgaagcgaaagtcctgcgtatgcgtttcggtatcgatatgaacaccgaccacacgctggaagaagtgggtaaacagttcgacgttacccgcgaacgtatccgtcagatcgaagcgaaggcgctgcgtaaactgcgccaccctagccgttctgaagtgctgcgcagcttcctcgacgattaattcgccgtacacgtataaacgccgccgcaaggcggcgtttttttatcaggtcatgcgcgagcgttctatttggcctgcagaatctctacacaacgcgagtattcgcgccctcattccccattgctatagcccacgcataatgagcgcttgatccagctcgcgataggcctcgaccagtttttccgttttaattcggtttaagccgctgggattcggcaacacccacaccatcgtcgcgccaatggcgatcttttgtttaccccaggcgataccgcgctggctgaatccctgttcaaaagcctgtttaccaagcaccgccagcgccgcgggctggtagtcctctatcttttcaatcaggttgcgtccgccgctacgtaattcatgcaacttcacctcagtcgcttgtaccgtcggtcggtcgacgagtttcgttaccccgcagcgaaaatccagtaatttttccgcctcctccggtttcaactgtcgatcggtgaaaccggccaaatgaataactttccaaaaacgattcgcgggatgcgcaaacggaaagccggtattcgccgaggagagtcccggattgatgccgcaaaaaaccacccgtagccctggcgccagtatgtccttaaccattattactcctgagcaatacaacgttctttaagtataacgggttgaaaacacattgtttataaaaacagcacccgcacggttacggctggattacagcgtaaagttacattataatccaccgccacggccccttagctcagtggttagagcaggcgactcataatcgcttggtcgctggttcaagtccagcaggggccaccaaattttagctttaaaatcatataattaagccactctaaagagtggcttttttgtttctgacagggctcgccccataccgctatttacgatgccaataggctgccgcacgtaccaggtgtggatcaaaccccttttcaaagcactgacttaaacgttttaccgttttgccttcgccagtaatccagatgaaatagtctgattctggtattgccagctgcgacaggcgcgtttgcattgcctgttcatcgccgccaacaacatattccacagtaatatccgtcaaatgggcgagataatcgcgatatgcggcatcctgaatgctcaccagcgcggttaccgcagggcgcgcaggcagacggctaagcgattccagacgacgacgtagcgcaggcataccggactcatcgcagacataaacctgacaagcataatcttccggcaccaccagcgaaccgcgcggcccgccaatcgtcagtgtatcgccttcacgggcttccattgcccaacggctggctacgccgccatcgtggataaagaaatccagcgccagctcgcgatgcgcctcgtcatacagcggcgtgtaatccctggagaccggacgaacgccctccccccagataatgccttcctcagtgactgtcgggggcgtaaagcgacagcctggctcagggaaaaaaactttcgtgtgatcgtcaaagcccagggaggtgaaaccgtccagcgcctcgccgccaagtacgatccgctgaaatcctgcgctaatacgttctacccgcagaacggtcagctcgcgaaaacgcagttcattacgaacacgctgtggatagcgtgcggatgatgtcgtcattttttgccttcgtgaagtaatacgatatatctaaattaaagttttaaatgataatgattgttaatcagtaaaaatgcaactgttttttgatagtgttctggcaacgcgtagctaactataaccttaagataaaaccttataaattaatagattatagcaaaaatggcttttacccttgctaaaacccatcatttagatataaattagatatatctaaataagcaggagacaatgatgcaaaatcaacatgaagggtgttgcaaaaaccaggatcataagcacgacggctgctgtaaagatcgagaacatcagcatgaaggctgccatagcgcgcatcagcatgagaacgccagttgcggcggcgaacatcgtcacggacacggctgtggtcgtcatggacagggcggtggtcggcgtcagcgattttttggccacggggaacttcggctggtcattcttgatatcctgacccgggacgccagccacggctatgaactgattaaagcgatagaaaacctgacggggggcggctatacgccaagcgctggcgtgatctaccctacgctggattttttacaggatcagcaatttatcacgattagcgacgaagaaggcgggcggaaaaaaatcgcgattaccgcgaacggcgcgcaatggcttgatgaaaatcgcgaacatctgacgcatattcaggcgcggctaaaagcccgttgtgtgggcatggagttacgtaaaaatcctcagatgaagcgggcgctggataacttcaaggccgtgctggatctgcggataaaccacagcgatatcaacgacgcgcaaatcaaacgcattatcggcgtgattgatcgcgcggcgctggaaatcgccgaactggattaagcgggctgcgtgtcctcttcgcggacgcggaacacgttaaccagctcttttaaatgtaacgcctgttcgttcagcgacgctgcggcggcaacagactcttccacaaggcaggagttttgttgcgtggcggcgtcaatcaggccaatcgcgctgttaatctgcgaaataccgtcagtttgctcgcggctggcctgcccaatctcacgtaatatcacatccatctcttcgacgttgtccaccatgccattaatcagggcgctggctttctccaccaggtgcatcccttcctgagtctgactggttgaatcttcaatcaaattacggatttcactggccgacgaggcgctcttttgcgccaactggcgaacctctccggcgacaacggcaaaaccgcgcccatgttcgcccgcgcgcgccgcttcaaccgccgcgttcagcgccagaatattggtctgaaaggcaatggaatcaatgatattgatgatatccgacatacgatttgccgtatcgttaatgacgcgcattttctgcgtcacttgattcatcatctccccattgtttttcactacgctggcggcgccagcagagagtttggtcgcttcactggtatgatcggctgtgtttttaaccgtggcggtaatctgttccatcgacgccgccgtttcttcaaccgagctggcctgctcttccgtacgcgccgccaaatcctggttaccggcgacaatttgcgccgccgccgtggagatactctccgaaccgttttgcacttcctgtacgatatccagcagacgcgttttcatcgccattaacgcttgcagtagtacgcctgtttcatctttatagtcggtggtgatatggcgagtcagatcgccatcggcaatcgcctcggcaaagcgtaccgcgtcatcaagcggtcgggtaatagaacgcacaatataccatcctattacgcctccggcggcgatgcttatcagcgccaaagtgattaacaacgtccgattatttttaaaatcctctttgacctgcacgctcgctttatgcatcagcgcgtcctgaacagcgataagttcctggactttgtccttatagactttttgcacctgcaccgttctggtcatcatctcctgaatggccgcctgacgattattgctttgaatatctttcaaaatacggaatctggactccaggtattgctggcgcgcttcacggatttcattaatgattttctgtgaatccgcatcgtgactattttccctggaaagctcatccagtaacgccgaaatgcgctggcttatctcactgagttctttctgcgagctctggctccagcgcccctcttcatccagtaacatgagctgctgcgcgatgatgaaatcattaaaattatcgattaacagattggcttttaccgtggtgggataatcattggtaataatgtcctgcatacccgtattagcccgatcaaggctaaacaaagacagagcggaactcaccaccatgagaacaatgaataagccaaaggccataaataattttgaacgtattttaatgttatgcaaaaacatattttctccctgggatcgcatatcctcatacaggaagatttatcggcaataatgttactaactttatgatattgatcgctttttatttcggaacattattagtaattaatatttattgttcacagaaagatgaaccaaaagtgacataaattggcactaataatgaaagaaatacgctaaaaggttaaccatttcttatttatcaactgagtttatacctattaataggtagacaagggagaaggaataaatatcacattatttttaacatcacaggccactggtactctctatgatggcaggcaccgccttctatcagagcacatccgcccggtaagcttgttgctaccgggcggatgtcattaccgttgctacctacaaataaacttaatgcagtaccgtgaccgcatcctccagccggctggcacggtgttttaccatcgcggagacttgtgcgctctcttccaccagcgccgcattcttctgggttatgcggttcaactcgtccacggcgcgagtcaggctggaaagcccatctgtctgttcctgcgtcgactggctgatccgtgcgataagcagggtgacattttgcacctgggctacaatgtcatccatggtacggcctgcggcgtgaacctgctcggagcctgactgcacctttgttgcgctggcatcaattaatttacgaatatcgttcgccgcgttagcgctgcggctggcaagatggcgtacctcgccagcaaccacggcaaaccctttcccctgctcgcccgctctcgccgcttctaccgccgcattcagcgccaggatattcgtctgaaaagcgatatcgttaattagcgtggtgatcgtcccgatacgttgcgtactgtgagcgatatcatccatcgttttaatcaccgtatccatcgcctcacctccctgagtcgccgcgctactggccgccatggaaagcttatccgcagcggaagccgtctcggaattgagcttcacggactccgccatctggttcatggtcgttaccgtttcctgaacattctccacggtctgacgggtgtgttcgttcagatcattgttacccttcgccagcctttcactgccgtttctgacgctggacacctgacttgatacgtcattgatcagccaacggcacatcaagccaagctgccccacggccctcagcgtcagccccaactcatcgctacgattaaggtgttgtacgctgttgcgttcgccggtcgccactttcagcgcctgcgtcgccacattttcaatgggacgcacaatttgccattcaaatagcgccgtacctgccagcatcgccaacgcgcccaacaacaacgcctgccatgaggcatccgtaccgaacagcgccaacgccagcattacggccattagccccataatgctacgcactcgccagcgaacaggcatcgcgggcagtttgcccagcaagccctgacgaaccaccaggcctttatgaatacgtttactacaccgcccttcatttagcgcctgatataaaggctcgacggcggcaatctcatcatccgtggcgcgggtacggatcgacatatatcccgtcacacgcccttcacgtatcatcggtaccgcgttggcccgcacccaataatgatcgccgtttttacgccggtttttcacaatgccgctccacggttcgccctgttttagggtgtaccacatatctgcgaaggcagctttcggcatatccggatgacgcaccagattatgtggccgcgccagtaactcgtttaactgatagccgctcacctggacaaaagtgtcattggcgtgagtgatatagctttccaggtcggtcgtagacatcagagtggtatcatcatccagcggggtatttagctggctgacgtagggatgagaagacatgatagcgtcctgtgcaggttatctggatgttaatttttcgctcagatgttatttcggcgctaatctatttatctttagttgttaaaattgctctggatcgcaatttgcgattaatccttaatatttgtacgattttcaccttatcctgcgccttattttcattatgaaattgtttagcgtggacaacctttttctttaaaatctgccctggctcacctttttctcacgccgccgctaacgcaacacaccgtaaaccgtaaaacaagatctgctcaaaatgcatccaattgttaacgtataacattaaatgttgtgtaaatgtgattattcctggtgtttatcccgattttcactatgggcttagacccccgctaatccctgcaatacttaattcagtatcatgtgatacacggctctctggagctcattttgaacaggttaccttccagcgcatcggctttggcctgtagcgcgcacgcactgaatctcatcgagaagcgaacgctaaaccatgaggaaatgaaagcactaaaccgagaggtcattgactactttaaagagcatgtaaattcaggatttctggaataccggaaatctgttaccgccggcggggattacggagccgtagagtggcaagcgggcagtttgaatacgcttgtcgacacccaggggcaggagtttatcgattgtcttggggggtttggcatctttaacgtggggcaccgtaatcctgttgtggtatccgccgtccagaatcaactcgcaaaacaacctctccacagccaggagttacttgaccccttgcgggcgatgctggcaaaaacgctggcggcgctaacaccggggaaactcaagtacagctttttctgtaacagcggcaccgaatccgtcgaagcggcgctaaaactggcaaaagcgtatcagtcgccgcgcggcaagtttacctttatcgccaccagcggcgcatttcacggcaaatcattgggcgcgctctccgccacggccaaatccaccttccgcagaccctttatgcctttactgccgggcttccgccatgtgccgtttggcaatatcgacgcgatgagcatggcatttagcgaaggcaaaaaaacgggcgacgagatagcagccgtgattctggagcctattcagggtgaaggcggcgtgatcctgccgccgcagggatacctgacagaggtacgtaagctctgtgatgaattcggcgcgctgatgattctggatgaagtacaaaccggcatggggcgtaccggcaagatgtttgcctgcgagcacgaaaatgtgcagcctgatattctgtgtctggcgaaagccctgggcggcggcgtgatgccaattggcgccaccatcgcgactgaggaggtgttttcggttctgttcgacaatcccttcctgcataccaccacttttggcggtaacccgctggcttgtgctgccgcgctggcgaccattaacgtcctgctggaacaaaacctcccggcccaggcggaacaaaaaggcgatacgctcctggatggttttcgacaacttgcgcgtgaatatcccaatctggtacacgaggcgcgcggcaaaggtatgttgatggccattgaatttgtcgataacgaaacgggctaccgttttgccagtgagatgttccgtcaacgcgtgctggtcgctggtacgctgaataatgcgaaaacaattcgtatcgagccaccgctcacgctaaccattgaactgtgcgaacaggtattgaaatcagcgcgtaatgcgctggcggcaatgcaggtgagcgttgaagaggtttaaaaacgatgccggatggcgctgtgcttatccggcctgttttccccgggtcgcggcctcttttttgaatcccatcacaatcaccacattccccttttcccttttacctcgcgacggctacagtagtaactcatccgaccacataacaataattttacatactggatacgcttatgagctacccgtcgctgttcgccccgctcgatctgggctttactactctcagaaaccgtgtgctgatgggatcgatgcacacgggtctggaagaacatcctgatggcgctgagcgcctggcggcattttatgccgagcgcgcgcgacacggcgtagcgttaatcgtcaccggcggtattgcgcccgttccctccggggtcgtgatgaccggcggcgcgatgctgaacgatgccagccagttaaagcctcaccgcgtggtgaccgatgccgtacatgcgcaaggcggtaaaatcgcgctgcaaattctgcacaccggacgttacagctatcagccgcacctggtcgcgccgtcggcaattcaggcgccaatcaaccgctttatgccacatgaactgacgcatgatgaaatcttgcagttaatcgacgacttcgcacattgcgcgcagctggcgcgggaagcaggctacgacggcgtagaggtgatgggatcagagggctatctgattaatgaatttctcacgcggcgaactaaccatcgcgatgacgaatggggcggcgactataccagtcgtatgcgcttcgcggttgaggtagtacgcgcggtacgccagcgggtagggaacgactttattattatctatcgcctgtcgatgctcgatctggtggaaaatggcggcacgttcgacgaaacggtacaactggcgcaagccattgaagccgcaggcgcaagcctaattaataccggcattggctggcatgaggcgcgaatcccgaccatcgccacgccagtaccgcgtggcgcctttagctgggtgacacggaaactcaaaggtcatgtgtcggttccgctgatcgcgaccaatcgcattaacgatccgcaggtcgccgagacgatcctgacgcgcggcgatgccgatatggtgtcgatggcgcgtcccttccttgccgatgctgaattcctgactaaagcgcaatccggacgcgcagatgagatcaatacctgtatcggctgtaatcaggcctgtctggatcggatcttcatcggcaaagtgacctcctgtctggtgacccacgcgcctgtcacgaaacccacatgccgataacgccggccatacgcaaaaagaatctggccgttgtcggcgcaggcccggcggggctggctttcgcgattaacgccgcgtcgcgcggccatcatgtcacgctgtttgacgcccagagtgaaattggcggtcagtttactatcgccaggcagatcccgggtaaagaagagttttacgaaacgctgcgctactaccgtcgaatgatcgatgttactggcgttacgctgaaactgaaccaacgggtgaacgcagaggatcttcagccgtttgacgaagcgatcctcgcctgtggaatagtaccgcgccgcccgccgatagacggtatcgatcatccaaaagtattgacctacctggaggtattgcgcgataaagcgccggttggtaagcgagtggcgatcatcggctgcggcgggatcggttttgacacggccatgtatctgagccagcacggcgaatccaccagccaaaatattgctgaattttgtacggaatggggaattgataccagcctgcaacaggcaggcggtctgcgcccggaaggcccgcgcctggcacgtagtccacggcaaatcgtcatgctgcaacgcaaagccagcaagccgggcgaagggttaggtaaaaccaccggctggatccatcgcgcgacgttactggcgcgcggcgtgaagatgatcccggcggtcagttactagaagatcgacgacgacggattacatctcttgatcggcggcgaaccgcagttgctggaagtggatcatgtggtgatctgcgccggacaggaaccccgccgtgaactggcggacccgttacgcgccgcaggtaaaacggtacatcttatcggcggatgcgatgtcgcgatggaactggatgcccgacgggcgattgcccagggcacccgactggcgctggagatttaacgactttgcctgatggcgctgcgcttatcgggcctatgccgtcataccggttttataggccggtatgacgcttgagtgccttatcgacggcgtccctgcttcaccgctttcagaataacaaatttattgttggttgctatcgtcgcgcaattaccgaaaatcttcttcagcttgtggaaatagtccagatggcggttcgccacaatatacagttcgccgttgattttcaggcagcggcgggcatgatggaacatctcccaggcgatattatccgtcagcgcatgtttctggtggaacggcggattgcagaacaccgcgttaaaacggaacggctccacgccggagagcgcgttgttgatcataaattcgcagcgttcgaacgcttccggcaggttcgtttctacattcaaacggctggaatctaccgccatcggcgattcatcgacaaataccacgttcgcctgcggatttttcgccagtaagctcaggccaatcaccccattgccgcagccgagatcgacaatctccccgtcgaggttttccggcaaatgctgcataaagaagcgcgcgccgatatccaatccggtacgagaaaacacattcgcgtggttgtgaatcgtccagcctgtatcttccagtttccagcttagcgtttgcggcgcgttggccagttgcggatgactgaaggtacagttaatcaggcgcgctttcttccacgccagcgtcgtcgtggttgggcccagcactttttcaaacagttccagcgtagaggtatgaatatcacgcgctttcgcgccggcgataatacgcgtttgcgccgtaacgaccttacgcaaagcgcgtaactgctgttccagcaacgccagtgttttcggtactttaatcaataccacgcccggtgcctgcgggtagtcagcggtactgtcgagaaacgttacgctggactccgcgatgccgttatggcgtaaattctctcgcgtacccagttcgcttaaatatgaatcgccaatactgtatggcgaatgctccgccagcgcacagcttagcgcgccaaacgtatcattcaggatcagcaccgggccgcgaatttccgtctcatccaactgttgcagcagatactcatcggccgcctcccacgccagaagcgggttaacatcatccgtttgcggaaaacgtttcagcgtcagtgaacggaaaccgtcgtctacgtggctcattaggcctcctgaatggtaaaattgcggcgttatccctgaaaagggtgcgtgagtatacactttttatcggcaacatggagctttgatgacctcactaacttaccttcaggggtatccggaacatctccttgcccaggtgcgcgccttaatcgccgagcagcgcctgggggcggtgctggaaaaacgttatcccggcgcgcatgattacgctactgacaaagcgctatatcactatactcaggaactgaaaagtcagtttctgcgcaatgcgccgcccatcaataaagtgatgtatgacagcaagatccatgtgctgaaaaatgcgctgggactgcataccgctgtctcgcgcgttcagggcggcaagctcaaggccaaggcggagatccgcgtcgccaccgtgtttcgcaacgccccggagccattcttacgaatgattgtggttcacgaactggcgcacctgaaagagaaagatcataacaaagcgttttatcagctctgctgccatatggagccgcagtaccatcaactggaatttgatacgcgcctgtggctgacgcatcaggcgctgtcggcacaataaattctgaaaatgccccttcccccgtatctttttaacggcgtgggcataaaatcgacgcgttcacatttcgctcattgcctgccgccacctcaaggatgacgatctgtagagggtattttttatccaccgccaacggaaccgcgcaacaaccatgctctcacaatgtgcccgttttatccgccgcctctgttttacacgccgggcgttaacagtggcgtgttttctgcttgtcgcagcaggcgtcgcgcttttctattccaactggcttatcgtcaacgcctcacagcatctgacatggaatgacattcagaccgttcccgcccgcaatgtcgggctggtattaggcgccaaacccggcaatcggtattttacccggcggattaatactgccgccgcgttgtaccacgccggtaaagtgaagtggctgttagtcagcggcgataacggcaaaaaagagtacgatgaaccttcggcgatgcagcaggcgctgatagcgaaaggtgtgccggaagcggccattttttgtgattatgccggattctccacgctggactccgtggttcgcgcccggaaagtgtttggcgaaagccgcattacgattatctcgcaagcatttcataatcaacgggcgatctggctggcgcaacaatatggcattgacgctatcggcgttaacgcgccggatctgaataaaaggcacggaacctacacacgacttcgggaaaagctggcgcgggttagcgcagtgctggatgccaaaattttgcatcgtcagcctaaatatctgggcgctggcgtcactattggggctgatagcgcacacgggtgcccttctcgccagtaaaatgccagagtgcgtcgcagcgcactggcaagggcggaaaggcgtgctacattgacgaaaatccctttctggagtccgctgacgtttatgatacgtttcgctgtaattgggactaactggatcacgcgccagtttgtcgacgccgcccatgaaaccggcaaattcaggctcgccgccgtttactcccgtagacttgaacaggcgcagtctttcgcaaatgattatcccgtcgagcatctgtttacctcgctggaagcgatggcgcaaagcgacgcgattgaggcggtttatatcgccagcccgaattccctgcatttctcccagacgcagcgctttttgcagcataaaaaacatgtcatgtgcgaaaagccgctggcttctaacctggcggaggttgatgccgctatcgcctgcgcgcgcgataatcagcgggtactgtttgaagcctttaaaaccgcctgcctgcccaatttcctgctgctgcgggaatcgttgccgaaaatcggcagaatgcataaagcattactaaattactgccagtactcttcacgttatcagcgctatctgaacggtgaaaatccgaatacgtttaatccggccttctccaatggttcgattatggatatcgggtattactgtctggcgtcggcgatcgcgctatggggcgagccgcgcagcgttcaggcgtcggcgaatttattggaaagcggagtagatgcacacggcgtcgtggttatggattacggcgattttagcgtcacgctacagcattccaaagtcagcgactcggtactggccagtgaaattcagggcgagaggggatcgctggtcattgaaaagctgtcggaatgccagaaagtgtgttttgcgccgcgcggcgcgctgatgcaggatctgacccagcctcagcatattaataccatgctgtatgaagccggggcgtttgcccagcttattgaaaaccacgccgtggaacatccggggttgtcgctaagtcgcgccacggcaaaatggctgacagaaatacgccgtcaaaccggggtcatcttcccggcggacgatctgactcatccccctactgcgtaaaattatgtaaatcgtatgttacaggtcattgactctacgcgtggcctgtcatactttgttacgcgcaaaggggagtaacttcattgccggtcgatcgtcattacgatgtgtgcaaaaccacatccggtcaccgggcagccataaaggaatgcgtcagcgtattcctttattgttgtaagtgagaccttgccgaatggcaaggtctatgcataaaagcagcggctaatgccattcggcattagtcgtttttttgcatggggagaaataatgaatactgttggtacgccattattatggggtggattcgcggttgttgtggtgataatgctatccatcgacttgttgttgcagggacgccgtggcgcacatgcgatgtcgatgaaacaagcggcaggatggtcaatcctgtgggtaacgctctcgctactgtttaacgccgctttctggtggtatctggctgaaacgcaagggcgcgaagttgctgacccgcaggcattagcgttccttaccggctatctgattgaaaagtcgctggccgtagataacgtctttgtctggctgatgctgtttagctatttctccgtccctccggctctgcaacgccgggtgctggtgtatggggttcttggcgcgatcgtgttgcgtactatcatgattttcgccggtacctggcttatcactcagttcgaatggctgctgtatgtgttcggcgccttcttgctgtttaccggcgtaaaaatggcgctggtgaaggaagacgaatccggcattggcgaaaaaccgatggtgcgttggctgcgcgggcatctgcgcatgactgatacgatcgagaacgagcactttttcgtacgtaaaaacggcctgctatatgccacgccgctgctgctggtgctgattatggttgagttcagcgatgtgatcttcgccgttgacagtattccggcgatctttgcggtcaccaccgacccgttcatcgtactgacctctaacctgtttgccatcttaggactgcgcgcgatgtacttcctgctgtccggcgtggcggaacgcttctcgatgctgaaatatggtctggcggtcattctggtctttatcggcattaagatgctgatcgtcgacttctaccatattcctatcgcgatttcgctgggcgtagtgtttggcattctgaccattacgctggtgattaacacctgggttaaccatcagcgcgataagaaactacgagcgcaataatcttttatcggggtaaacctgccccatcaaaaacgcccggcagcgtacacctgccgggcgtttttgtttaacatgtcacaatactgttaatataaagttataaaacatgatcacagcaaaaaatccaggatatttcgcttcccgaaccttcaactttccttatactcaaccaggcaaacactttgttacatcctgaaagatgcgccgtaagagcgtgcaggggatgaccagcaacacaatacaaggaatatgaaatggctacgcaacgagcatcagggctactgcagcgtttagcgcaaggcagtctggttaaacaaattttagtgggtctggtactggggattttactggcatggatttctaagcctgtggcagaagcggttggcttgcttggcaccctgttcgtcggcgccttaaaagcggtcgcccccgttctggtgctgatgctggtaatggcctcgatcgccaaccaccagcacggccaaaaaaccaatattcgccctattctctttctttacctgctaggcaccttttcaaccgcgctggcggccgttgtgttcagcttcgccttcccttcaacgctgcatctgtccagtagcgcccaggatatcgtgccgccgtccggcattgtagaagtcctgcgcggtctgctgatgagcatggtgtcgaaccccatcgacgcactgctgaacgctaactatatcgggattctggtgtgggccgtcggtctgggatttgccctgcgtcatggcaatgaaaccaccaaaaacctcgtgaacgatatgtctaacgccgtgacctttatggtgaaactggtgatccgtttcgcgccagtcggtatttttggtctggtttcatcaacgcttgcaaccaccggcttctccaccctgtggggctatgcgcacctgctggtcgtcttgattggctgtatgctgctggtcgcgctggtggtcaacccgctgttggtattctggaaaattcgtcgcaacccttatccgctggtgttcgcctgcctgcgtgaaagcggtgtttatgccttctttacccgcagttctgccgccaatattccagtgaatatggcgctgtgcgaaaaactgaatctggacagggatacttactccgtttccattccgctgggtgccactatcaatatggccggcgcggcaattaccattacggttctgacgttggcggcagttcatacgttaggcgtcccggtggatctgcctacagcgctgctgctgagcgtggtggcctcgctgtgtgcttgcggcgcctccggcgtggcaggcggttcattgctgctgatcccgctggcgtgcaacatgtttggcatcccgaacgatatcgcgatgcaggtagtagcggtcggctttattatcggagtattgcaggattcgtgtgaaacggcgctgaactcatctaccgatgttctgttcactgcggcagcctgccaggcagaggacgaacgtctggcgaataacgccttgcgtagctaagtgattatcaatgccggatggcgcgtgccatccggcgtgacgataaatcagaatctcccaatccataggctgtgacggaaagcgaattgatgttcacgcgcgacatcctcgcgtaacgttatatgtagatggcgtctgccgcagcgctcggtcagcgtaaagtataaagtgtcagcctgtgtaaatcctctcgccaccctcctttgcgataagcaaaatcaaagctcaacgacgcgtaatttctataacggacttcgttgacctttgttacaattagatgcattttgaatttttgtgtgttagtgcttgcttacttcacaacttaacaaggaatagttcaggccgcgaatttgccgtttccgcaacgctgataaaaactccaactctgttgcggtagtgcaaacctcagatcaccggcgtgacgttaaccgattctccaggaatactgaatggaactactgactcaattgctgaatgccctgtgggctcaggactttgaaacactggccaatccttccatgattggcatgttatattttgtgttatttatgattttgtttctggaaaatgggctgctccctgccgcctttttgcctggcgacagcctgttgatactggtcggcgtgctgatcgccaaaggcgcgatgggttttccacaaaccattttgctgcttaccgtcgcggccagcctgggttgctgggtcagctatatacagggtcgctggctggggaatacccgcaccgtgcagaattggctctctcatctccccgcacattatcatcaacgcgcccatcaccttttccataaacacggcctgtcggcattattgataggccgttttatcgcgtttgtcagaacgctgctacccaccattgccggcatatccggcctgaataacgcgcgctttcagtttttcaactggatgagtggcttgttgtgggtgcttatcctgacgtcgctgggctatctgctgggcaaaacgcccgtctttatgaagtatgaagatcagctaatgtcatgcctgatgctgctgcccgtggtgctgctcttttttggcctggcgggttcactggtcatgctgtggaaaaagaagtatgggagccggggataacttatgcttaaaccacgcataactgcccgacaactcatttggatcagcgcttttctgctgatgctgaccatactcatgatgacgtggtcaacgctgcgtcagcaagagtcgacgctggccattcgcgcggttaatcagggcgccagtatgccagacggcttctcagttctgcatcatctggatgcgaacggcattcattttaaaagcattacgcctaaaaatgacatgttgctcattaccttcgattcccctgcgcaaagcgccgcagcaaaaacagtgcttgatcaaacgttaccacacggttatgtcgtcgctcagcaggacgatgacaacgaaacggtacagtggttgtcccgcttacgggaaagctcacaccgctttggctaatctccaggaatccgaatcatatcactcactttggtgatttcattgtttaatgactatgattaataaagcggtgcttaacccaccgcgttattatcgggatcaccgccccggacaacgggtccgaacataagggaaagttcaggaatgaaataccgcatcgctttggctatcacgctttttacgcttagcgccggcagctacgctaattcgctttgtcaggaaaaagagcaggatatacaaaaggaaattagctacgctgaaaagcacaacaatcagcgccgtattgagggtctgaacaaggcgctcagcgaagtacgcgccaattgtactgacagcaagctgcgcgccgagcatcagaaaaagatcgctgagcaaaaagaagaggtagccgaacgccaacgtgatttagccgaggcaaaagcaaaaggcgatgcggataaaatagacaaacgtgaacgtaagctggccgaggctcaggatgagctaaaaaaacttgaggccagagactactaaattaacgccgaatgtaaatactcactcacctggagaaaactatgtcgaaagataacactacggaacatctgcgcgctgagttgaaatccctgaccgatacgctcgaagaagtgctgagctcttcgggcgaaaagtcgaaagaagagttgagtaagattcgtagcaaagccgagcgcgcgctgaaagagagccgttaccgcctgggcgaaacgggtgatgtgattgccaaacagactcgcgtcgccgccgcccgtgccgatgattatgtgcgcgaaaacccctggacaggcgtaggcattggcgccgctgtcggtctggtgttgggcgtactgctgacgcgtcgttaattatggcggactctcgacaggcacaaggaccaggcaaaagcgtactgggtatcgggcagcggattgtcaccattatcgttgagatggtggaaacccggctgcgactggcggtagtagaactggaagaagagaaagcgaacctctttcagcttttgctgatggtaggtcttaccatgctcttcgcggcgtttggcttaatgagcctgatgattctggtcatctgggctatcgatcctcagtaccgtttgaacgcgatgatcgctaccacagttgtactgttagtgcttgcgctaatcggcggcatctggactttgcgcaaagcgcgtcagtccacgctattgcgccatacgcggcacgaactggctaacgatcggcaaattctggaggacgatcagtcgtgagcagcaaaggcgaacgcgaaaaacgtaaagcgctgcttctcagtcagatccagcagcaacggctggatctgtccgccagccgtcgcgactggctggagaccaccggcgcgtacgatcgcggctggaatacggtgttaagcctgcgctcctgggcgctggtcggtagcagcgtaatggccatctggaccatccgtcatcctaatatgttggtacgctgggcgaaacgcggcctgggtatctggagcgcctggcgcctggtaaaaactaccctccgtcaacaacagctccgcggttaatatcttttcttttatagcatcgcgccatcaggttatcacccgattacacctggtggcgcgatacttttatgcatatcgtctctttatcaatcactcaaattttttgaaaaaatttggcaattttccttgctaacaattcctgtacgccacgtttatgattctctccagcgataacaatgacgcgctaaaccgcgccattgctcatgaaaatagcagcagccgccgaatcggcctcctggagaataaaatgaaaaaattagaagatattgatgtactgatagcgcgtattttaatgccagttctgtttattaccgcaggatggggaaaaattagcggctatgcgggcacacagcagtatatggaagcgatgggcgtaccaggattcctgctgccgctcaccatactgcttgagttcggcggcggtctggcgattctgctggggttcctcacccgcaccactgcgcttttcaccgctggttttacgttgctgacggcattgatcttccatagcaattttgcagaaggtgtaaactcgctgatgtttatgaaaaacctgaccattgccggaggattcttattactggcgttaaccgggcctggcgcgttcagccttgaccgtctgctgaataaaaagtggtaagcaatctatactcaattaaaaaagcgagggaatagcgcctcgcttttgttatctgaaggagagagacatgggacaactgatcgatggcgtctggcacgatacctggtatgacaccaaatcttccggggggaaatttcagcgttcagcgtcggctttccgcaactggcttaccgctgacggcgcgcccggaccttccggcgaaggcggattcgccgcagaaaaagatcgttaccatctgtacgtttcccttgcctgcccctgggcgcatcgcacgctcattttccgtaaactgaaaggtctggagccgtttattccggtttctgtcgtgaatccattgatgctggaaaacggctggacgtttgatgatacttttccggcggccaccggcgataccctctatcagcatgaatttctctaccagttgtatctgcacgccgatccacactacagcggccgcgtcaccgtgccggtcttatgggataaaaaaaatcatactatcgtcagcaacgagtccgccgaaatcattcgtatgtttaactccgctttcgatgggctgggcgctaaagccggggattactatccccccgcgctgcaaagcaaaattgacgagttaaacggctggatttatgacaacgttaataacggcgtttataaagcaggcttcgccactagccagcaagcgtatgatgaagcggtagaaaaggtgtttactgcgctggcgcgcctggaacagattctcggacagcaccgctatctgacgggcaaccagttgaccgaggcggatatccgcttatggacgaccctggtacgctttgatccggtttacgtgactcatttcaaatgcgacaaataccgaatcagcgactacctgaatctgtacggtttcctgcgcgatatctatcaaataccgggcattgctgaaaccgtcaatatggaccatattcgtcaccactatttccgtagccataaaacgattaaccccacgggtatcatttctgtcggaccgtggcaggatctgctcgaacctcacgggcacgacgtgcgctttggctaatttcaggcgtcctccgggacgccttattaataaatgccacaaatatttaccagcatttcattcgcagctattcttagtttgattactttaaaaacaagtgattgaaccattattgaggcgaaaatggattggtatttaaaggttttaaaaaattatctgggatttggcggccgcgcgcgacgcaaagagtactggatgtttattctggtcaatatcatctttacctttgtgttgggcctgctggacgccatgcttggctggcaacgcgccgggggtgaaggcgttctgaccaccatttacggcgttctgatctttttaccgtggtgggccgtgcagttccgtcgtctgcatgacactgaccgctccgcatggtggctactgttgctacttatccccattatcggctggcttatcatcatcgcgttcaactgccagaatggtacaccgggcgacaaccgcttcggccccgatccgaaacgtttttcctgagggcggcgcggcgccgcttttaaagcgccgcgcgctatttattttccggcgaatagcttaggtatttcccgcaggcaccaggcttttgcctcccccatactgtcgcgccgccaggccataataatatcgatttcgctggtcgattccgggctgactacgcgtagccgcccttcggcaatatcctgttccaccatcgaatatggcatcgtcgcgacgccaagcccggccagcagcgcctgacgtttatcttcaatcgtgcttaccgtcagacgtggctgcttatccagcagttgcaccgttaataccggccgctcgcgcgcggtatccgctaccgctacgccgcggtatttaacccgcgtcacttccgaaagcggctccggctcctgatgaatagagtggtcaggcgcggcgacatacacattcattaacgtatacaacttacgggagttaatttccgacgacgatcgaaaatgcatatccggggcgataacgatatccgcccgtccctgctcaagccgctcccatgcgccagccagtacttcggtaatcaatgaaagctgcgtattggctttagcggccagccggtcgatcagcggaaaaaaagcaggcgtcggtaccagagcttcagtgaccagcgtcagatgcgtttcccaaccgcgggccaacgcttcagcatccgtcgttaacttgtctgccgcttccagcaatacccgcccgcgttccagcagcatacgtccgacgttggtgaattttgtacgatggccggagcgatcgaacagtacaacgtccaactcttcttccagcttctgcatggtgtaactcagcgcggagggcacccgccccaactcatcagccgctgcggcaaaactgccccggcggtcaatggcgtccatcacacgcaatgcttcaagcgtcagcgctctctctttagccataacgttctcattcaggaaatttgaacataccgggcagaatatctggctaacaatgcagcgtccagccccttaacataaaaggaagtaaagagaggttaataacgatgattacgacccgaaccgccaaacaatgtggacaggcagactacggatggctacaggcccgctataccttctcctttggacactacttcgaccctacactgctgggctacgcgtcgttgcgcgtactgaaccaggaagtgctggcgccgggcgcctcttttcagcctcgaacttatccaaaggtggatattttaaacctgattctggacggcgaagcggaataccgcgacagcgacggcaaccatgtacaggctaaagcgggcgaagcgttgctgctcgccgcgcagccgggcattagctacagcgaacataatctcagcaaagttaagccgttaacccgaatgcaactgtggcttgacgcctgtcctgaacgggaaaacgcgctggtacaaaaaatcccactctcgacggcgcaacaacagcttcttgcctcgcccgacggtgagcaaaacagcttacaactgcgccaacaggtctgggtacatcatattacgctggagaaaggcgaatcgcttaacttccagcttcacgggccgcgcgcctatttgcagtcgattcacggtacgttccacgcgatgacgcacaacgaagaacgcgaggcgttaacctgcggagatggcgcatttattcgtgatgaacctaacattacgctggttgccgatacgccgctgcgcgcattactggtagatttaccggtgtagccagccagaaaaggagtcgcaagatgagcaaaaaatcggcgaagaaacgtcagcccgtggtaaaacctgccgtacaggaggcgatgagcgccgctgtgccgctgggctatgaagagatgctaaccgaactggaagccatcgtggcggacgccgaagcccggctggcagaagaagaggccgcagcctgaaatcatgccggatggcggcgcaagcgcccgatccggctgataacgggtagacccgataagcgcagcgccatcgggcaacacgctgccccgacgtcatgccggggcgttattattaatgcgctttactggccataatctcgatgatctgcttgtctgtctgctgcattgagcgacacgccagcgaacacaaattcgaaatagattgttcgacattgtgcgccacaatcccttcgtttccggtcaccgccgtatcatccaacgccatcagtacggctttccacgccgccgacgcgctggtagagactttcatcgcgcagctattcgacgcgccatcgcaaatcatcccgctgacatcaccaatcatactgctgatagccattgcgatagtgtcgtaacgaccatctatcagccacgccatacccgctgccgcgcccattgccgccgtagttgccgcgcacagcgccgacaaacgcggaagctgatggtgaatatagatagcgctcaaatgcgataacattagcgcgcgcgccaggcactcgtcatcggcgccgacatgttcagcaaccaccatgactggcaccgtggcggtaatcccctggttgccggagccggagttgctcatcgcgggcaacgtggcaccgcccattctggcgtctgacgccgcgctggtacggatcaaaatcgccgtggagagatctttcgccagcagaccgcgatcgcactgtttggccagcgtcgaaccaatatgcagcccccaggaaccacgcaagccctcctgcgacaacgcgccgtttagcctggccgcatcgagaataaagcggatagcgtcaaagggcaccgcattcacaaacgccaggatctcttccagcgaggtatgagacagcactcccagtggcgaggttttttcttcttcctgcgcattatcggcttgggtaaataccacgcccttgtcggtttctatccgcacaatatttgtatgatcgccgacgatcgtgacacatgcccagctatcgccgctatacactttcgcccgtgaaaacaggatatcgttacatggctcctgcaacatcactgcaacatgtccggcggccagcatcgcttttgcatcggcaacggctttagcggaagcgtcttttaacacctccaacccggctttcgcatcaccgcccaacgcgccaagcgccgcggcgatcggtagccctaccattcccgttcctggaacggtaacgcccataccatttttcatcagattaggcgaaacccacgcgtcaatgcgttcaactgtgccgtcaagttcagccgccgccgccgctgctgccagcgccagtgaaattggctcagtacaccccagcgccggttttacttcttcctgtacggccaggataaaactttgccacaatggatttattttagattcaaacataacaacaaccttaatctcaggtatatcaagagaatgccaggaacggagaaacgcatagcagcagaccggtaataataatcaggtacaacgaagcgcctttatatttgtgcaatgcgggaaccttgtagaccaaccatgccggaattaaacagcccaccataccgaagatagggctacaaatagaggtgaagctcagtaccggcgcgttgagcacaatggcgctccaggccagcaaaatagcgaaaatcataatgccgcgctgtaccagattttccttaatcttctcggcgggcattttgcggcgcaggatattcatcacaatgccttgcgtcgcttcgcggaatcctaaataaacgccaaagaaggcggtcatgacggcaaagatgttcagaattacgctaaccactttgacccagctagcgccatcgccgctaataaattgcgcggcgatcgccagggcggaaatattctgctcgtaggctttcaccgcttcgtcatgccccatcgccagggtgaaggaaaccgcatagaaaaagacggtaacgaacaggatgccaaacgcgatattcatggcgcgcagcgcttatggcgtgcgacctcaatagatttttcgcgtgaacggtaagagatcaccattgggcttaacgtctggataaataaaatcgaggtcagcgtaaatggcagggtaataatggcgtttttaatcagcagggccatcggcggcagcgcgccaatgttatacagatgccacatacccaccatagagacgcccagcgccgccactaccagtagcttggtcagcaccatgccggtggaaattttgaacagtaatttttcaccgcgtgaggaaatcgccaccaggatgcagatcagcaccagaccataaaatggactatcggaaagtaatccttccgttacgccgaaagtatgcagataagaggcgctgtcgttagtaatcgccgtagaatagacgaacatccagatgacgagcatcacaaagtacagcgcgcctaataaaataccccagtttttgcccagatagccgctgatcacgctggggtagtctttacattccggggattccgccagcgtattaataaacagccgctggaacaggtacatggccggataaccaataatagaagagagtaaaaagacccaaagtcccatcaggccaacctagacaggaagaaaaacgatccctgcgccgatcgccatcccgatactcataatgacccagccggtgtcggtactatcaaatttgatggcttcacgccattcgctttctgtcatccctgcccgacgcgccggggctgatgcgtcgaggattacgctggtattactagccgattccataaaattctcgctcaatgtgtaggtagaggtttttttatttttcgtgccgcagcaaggcgatatgcagaacgtgaggtgcaggtactttcttgtaataagaaaatcatacgcgcacgataagagaaaaacttaccaataaaacgcctgcatttcttgtgggttaagaattattttctatttactatttatttaatattgttattttctctatttgacgcgtatcacaacaaaaaagggcgcactttggtgcgcccttttctcagcttctgtcttctgcgttatcccatagcctgctcactctgcgcctgtcgggcctatccacaaacgactttaatcgccagaccgccgcgcgacgtctcgcgatatttgtcgttcatgtctttacccgtttcgtacatggtttcgatcactttatcgagcgaaacccgcggctcagaggtacggcgtagcgccattcgcgccgcatttaccgctttaacggcgttaatcgcattacgttcaatacaagggatttgcacctgacccgccaccgggtcacaggtgaggccaaggttatgctccatcgcaatttccgccgcaatacagacctgcgccgggctgccgcccagcagttctgtcagccccgccgccgccatcgaacacgcgacgccaacctcgccctgacaccccacttccgcgccggatatcgaggcgttcatcttgtacagcatgccaattgcccccgccgacagcagataacgggcgatagagttggcattgaccggacgacggaatttgtcgtaataggccagcaccgcgggaataatgccgcacgcgccgttggtcagcgcggtgaccactcgcccgcccgccgcgttctcttcgctcacggccagggcgaacatgttaatccagtcgatgacgttcatcggatcgcgggagagattatcgctggagaccagcagacgccgtaacgctaccgcgcggcgtgggacgttcagcggccccggcagcacgccctcagtattcatgccacgttcaattccggtcgccatcacctgccaaatgcgggcaaagccagcgtcaatctgctctttgctccgcaacgccagttcattttgcatcatcaggccggaaaccgagagcccctgcctttcacacagcgtcagcagttcgctggcggaatgaaaatcatacggcaccgatttttctacgtcgtgcgactgaccaaaacgttcctcttcgacaataaagccgccgccaatagagtaatacgttttgtgtaaaagcggcgtttgcccgtgccaggcggtaattcgcataccgttttcatggcgcgccagggtttcagcgtgaaagagaatactgtcggcgacgggaaaatccaccacatgcgcgccacccgccaccgataaacggctgctgcgggcaacctcctggataaacgccggaatgctatcaatattgacatcctgcggcgtattgcccgcaagacccataatgatggcggtatcggtcgcgtggcctttgcccgtcagcgatagcgatccgtaaagatcaaccgtgatgcgcgtcgttcgcggcaggtcgccgctgtcgatcagccgatcgataaaacattttcctgcattcattggccctacggtatgggagcttgaaggtccaatgccaatcttaaaaatatcaaatgcgctaatcatatctccccctaagattaccgttcagtgaagatccgtcgcggggcgatccacacgatcgccccgttcacgttacatcgcctgagtaaaggtgcgcgaaataacgtcctgttgctgctcacgagtcagcgcattgaagcgcacggcatagccggaaacgcggatcgtcaggttcgggtagttttccggatgttcaatcgcatccagcaacatttcacggttcatgacattgacgttcagatgctgcccgccttctacctgtgcttcatgatggaaatagccgtccagcaggccgacaagattggttttccgcaccgcatcttctttcccgagcgccgcaggcacaatcgagaaggtgtacgaaataccgtctttggcgtaggtaaacggcagtttcgccaccgacgtcagcgaggccaccgcccctttgcggtcacgaccgtgcatcgggttcgcccccggcgcgaacggcgttccggcgcggcgtccatccggcgtattgccggtcttctgcccgtacacgacgttcgaggtgatggtcaaaatggactgcgtcggcaccgcattgcgatacgtcggcaacacgctaattttttgcataaagcgtttcaccaggtcgcaggcgatgctgtccacgcgctcatcgttgttgccgtactgcggatactcgccttcaatagcaaagtcgatggcaaggccattttcgtcgcgaatcggcttcacctgagcgtacctgatggcggatagggaatccgccgccaccgacagtccggcgatgccgcacgccatcgtccgatacacatcacggtcgtgcagcgccatcagcgaagcttcatagctgtacttatcgtgcatatagtgaatgatgttcagcgcgctaatgtactgcaccgccagccagtccataaaatggtcgaggctctccattactgcgtcataatccagcacctcatccgttaacggcgcggttttcggcccaacctggattttcagtttctcgtcaacgccgccattgatagcgtacagcaacgttttggcaaggttggcgcgcgcgccgaagaactgcatctgcttaccgatgaccatcgggctgacgcaacaagcgatggcgtaatcgtcgctgttaaagtcggtacgcattaaatcgtcgttttcatactgcaaagatgaggtcacgatggagacctgcgcagcatatttcttgaatgccaccggcaacgcttctgaccacagtatggtcaggttcggctccggcgctggccccatcgtgtgcagggtatgcagataacggaaagagttcttcgtcaccagcgtgcggccatcaagccccatcccgccaataacttcggtggcccagatcggatcgccggaaaagagcgaatcaaattccggcgtgcgcaggaagcgcaccatgcggatcttcatgatgaaatggtcgatcagctcctgcgcctgctgctctgtcagaagacccgcgttgaaatcgcgctcaatgtagatatcaaggaacgaggcggttcttcccagcgacattgcaccgccattttgcgattttaccgccgccagataagcgaagtagagccactgtaccgcttcctgcgcgttccgcgccgggcgggagatatcatagccgtatttcgccgccatctcctgcatttgcagcagcgcgcgacggtgctccgccaactcctcacgcaggcgaatcgtcgcctcaagattctgtccccgctccagattcgactgcaggtcggcgaattgcagctcgcgttcgcgcaccagataacggatgccatacagcgcgacgcggcgataatcgccaataatgcgcccgcgaccataaccatccggcaaaccggttaatacgctggatttacggcagcgcagcatatccggcgagtaaacatcgaatacgccctgattatgggttttccgcaggtcggtaaaggtatattcaaaatcggcgtccatttcccggccataagcgtggaatgaacttttgatcatgttaacgccgccaaacggatgcaaagcgcgtttaagcggcttatccgtttgtaaaccgacgattttttccagctctttttcaatataccccgcatcgtgcgcggtaatcgtcgtcgcgatgttggtatcgaaatccaccggcgcatgggtcgcgttctcgatacgtattcccgccatcaccttttcccacaacgctgtggtcgctggcgtcgcgtcggcgagaaaagattcatccccctcatagggcgtatagttatgctgaataaaatcacagacattaatttcttctttccagtccgtacctttaaaatcacgccatgcttcggcatacagcatatcgctggtatcgatatttaccttcatgaaaaataatctctctacagaacagccgttaagttatgcaaattccactggtgctttcacgttgcctaaatgaatggcatcaagggcaatcattttctcttcattcgtgggaataacagcgcaaataacctgagaagggttaacggaaataatgcgctcgccgtgagaattcggctgcttattcatttcaacgtctaacgtaagccccagtacgcccaaatgttcaatgaccaactggcgaattaatactgaattttcaccaataccgccggtaaaaataatgccatccagccgatgtaacgatgccgcgtgtccggcaatgtgacgggcgatacggtggacaaacgtttttatcgctaaccgggcgcgctcatgtccttcgtgccaggctttttccaggactctaaggtcggatgacaacccggagatgccgagcaaaccggactctttattcaccactcgctccagatcgctcaacgtctgcccggtttctttggctatccacgccatcgcgccgaaatcaacgtcgccgctgcgagtgcccatcatcagcccctcaagcggcgtcatccccattgaggtgtccacgctctgaccattgcgtaccgcgcagatagacgccccattgcccagatgcgcgacaatcagacccgagtttttttcatcgaggtcaagcagttcatacgcgcgccgcgaaacatagcgatgcgacgtaccgtgaaagccgtagcgacgcacacccaggctggaaaaatattcccacggcaatccgtataaataggcttccggcgccagcgtctggtggaaactggtatcaaataccgccacctgacgcacggccgggaaaaggcgccgcgccgcgtcaatgccgcttaaattagcgtaattatgcagcggcgctaaaggtgatacccgacgaatattatcgataatctcatcggtaataatgacggactgcgtaaatagctctccatcgtgcgcgatacggtgaccaattaatgccacgctatccgttaaatcacgtttttccagctcaaaggcaatggcttttaacgcgtcctcataattagagtgcgagaggtttatcggcttatcgccattaatagataaaaaggcgttttcagtattcattccatctgctattcccgccattaaaacatcacaggtagcgacatccagtacagagaatttgatagaagatgatccgcaattaatgaccagaacgaccggaaattcattcatgtagtgcctccgtcgatgtcagcctgcgtccacgccctggggcggaacgcaggctaaacgtgaggattagaacaatttgtagacaatattcaggatggtcagcagaccaatcagggtgacgaacacgttatccagacgaccacggtacttcgccagcgacggcgctttacgaatggcgtacatcggcagcaggcataacagtgaggcgataatcggcgcgcccatcgcttcaatcaggtccagaatgttcgggtttgcgtaagctacgacccaggtagatcccataatgaagatcatgctgatggtattaagcttgcccatagagactttggttttatcgcctttataaccgaatttcagcaccaggccgttcagcccttccagcgtccccaggtagtggccgaagaaagatttgaaaatagcaaccagcgcgatgatagacgcgccatactccagcaccgttgcaaaagtggattttgtccccgacaaagaggcgaaatggttggccaggtaggaaagtaccggaatgttctgcgctttcgcatccgccatgttctgcggggagagcgtaaacagacagctaaaggcgaagaacatcaccacggcgaccatcagcatatggcgcgcgagatgatctgtgaacatttacgctcggtaaattcgcggccaaactctttctcatactcttcacgcttagacaccacgaaggaagagacgatgggcgaaaagttaaaggagaacaccataatagagatgcccagccacaccgtaaccagtatgccatcgtgcccggtcagcgcgatattactgagatcaacctgatcgataaccgccgagttccagtaaggaatcagcgataatgagattagcaccagactggcgataaacggccataccaggtaactcatcaccttaaccatcagatctttaccaaaccagatcacaaaggccatcagcagcagcaagaacagcgccacgaaaccgcgattcaacgctggtatctgcaactggttttcccaaaacgtcatgaacgtgttagtaatggtgacgccataaatccacagcagcggacaaatcgcaaagaagtaaaggaacgtgataactaccccgcccgttttaccaaagtgctcttcgaccgtttccgtaatattgccggacggattagacccggataaacacagacgcgccagcgcccggtgacaatagaacgcaatgggataagctaaaaccagcatcagcagaatggggataagcccgccaaacccggcgcggatagggaagaacagcaccccggcgccgatggcggtaccaaataaacccagcgtccacgtcgtgtccgatttacgccatgacgactgttttgcctggctggatacaatgctatcagtagtactcatatcctatcctcacgaaaagattaagcgtcaactaaacccgtaatttgtgatacacgagaaagatcgatattgccgccagaaataatactgaccgtttttctgttctgaatatggctatctaatttcccgcttaatagtgcggcgcaggccagtgcgccagcgccttcagtaataaccttattgcgctgaattaaagcgatcatgctgttacgaatttcatcttcgctaaccagaacaatgtcatcgactaattcacgaacaatttcataggttaaattacccgggcgggagacatcacaaccatccgccagggtgccggtcgttcggtgcgcggttatttcgccagcgtaataagacgccgccataccgtgaacattttcggcctgtacgccgataactttaatggtcgggttaatcgatttaatcgcaatggcaatacctgcaattaaaccgccgccgccaataggcacgatgacattatcgacatcgtacagatcttccataatttccagaccaatagtaccctgcccggcaatgacttttggatcgtcgtaaggcggaataaaaatgcggccttcggtttcgacaatttcactcaccttagcaatggtgtcattgaagttgtcaccgtggagcaccacttccgccgaataatcacaggtggccgccacttttgactttggcgcgcccttcggcatcacgactttgccgtcaatacccagcattgcgcaagaaagagaaacgccctgtgcatgattacctgtggaacaggccacgacgcctttacgtttttccgcctccgttaacgagctaagtttgttaaaagcgccacgaattttaaatgaacccgtacgctgcatattttcaaacttgagaaatatttcgcctttgcaacgttcactaaaatagttagagcgaggcattcccgttttatatatcttccccgccagtctttttttcgcttcgaggatatcttcaattgcaaccgggagatcgtatgtaatgtgcattataacctcttaacctgggtattaaaaataagttaccgttgcccactgttcaaaagaaacaggtggcgtcaatttcgctaaatatgtttattccatatcattcaatttctattaactgcctgcgtctgcatccattatatgatgaatattgcttagccaattctactaatactgaagcggcttttttgatacgataatttttagaccataccgccgcataacgtgcgacgggtaatgtgtctttgattggtatcgtgataaattgattagagccaaaaggcgtggtcatatcgcagggaataacagttaagaaatcagcattgagaacaagattatatattgtgacaacggaatctgttttaacaatgttttcgatgctgatgccatttcgttgtagagtggtgagtaattcgctgtagtagcccatattcgtttgcggcaacgcccactgttcgtcctttaacgattccagtgtgatggtgccggtgcatgttcgggacttgctggctaccaggacaaactctgattcaaacagcggctcgacatgcagatcctgtagctgcatttcattactgagcgtaccgatagcaaagtccagccgcccgtcgcgcagggccggcaggaatgaagagagctgggcttcgtacatggatacctgcgcttttggaaatacctctttgaacttatgaatcatatcggacatgaaggtaaagccaatcagcgaaggaaaaccaaacgagacgtcgacaacggtattgcacgtcatactgttcatctcgttgatcatgtttttcatttcgcgggtgatagattcagaccaggaaagcagtacctgtcccgcttcggtcaacgtaacgccggtatttttgcgtacaattagctcaacgccaaaataggcctcaacatcgctaatgattttactgacggcgggttgggttaaccctaacgattttgcggcagaaccgatagaaccacttctaatgacttcctgaaagaccaccaaatgctgtgttttagggagaacaagagtattcatatctaccgctctgaaataacattgtgaacggcaggaagtgtagcaaattaaatcttaaaggttatgtgcgaccactcacaaattaacttaccgcaatttttacatggtctttattaaataaagaaaacctattacttcaatgagttacaaaaacaagacagtaacttagcctgatttcaatcaaaaaaaatggtcgggataacgatatattatggcgataaccagcctattttatctcctattttcgacatcccatgaagacgatatttcaatcaattacgggacattttatcgacaattccagcgttaaatttaaaacgtaatttctcaaatttaagtataaaccgaaggtaaatgcgcttaaaaaccgttacgcgtcacatttttttaccttatttgtttgtaaagaaacatttaataaaattttaaccaaaatatttcatacatttaattttcatttgcaacaaataatttacaccgttttcttgctgtttttcaggatgtaattttgtgaaagaaatcgattgcttttcacttcaactaaaaagagcgcaatccatagcgttttgtgtttctcatcacaaaaacgaataatattatgtcaccacggctgtcaattaattgccggatggtgacactggcgtcttctgcaacctctatacccttcaccggcctgataagcaaaaacccgccgaagcggattttatgaagaggtgaaactgaccgataagccgctttctttcgggtatagcgtcgtggacagtcattcatcctgccgccctgtaaaagcaaaaacccgccagcttacactgacggggtttatgaagaggtgaaactgaccgataagccgctttcttttgggtatagtgttgtggacagtcattcatcctgtcgccctgtaaaagcaaaaacccgccgaagcgggttttatgaagaagtgaaactgaccgataagccgctttcttttgggtatagcgtcgtggacagtcattcatcctgccgccctgtaaaagcaaaaacccgccgaagcgggttttatgaagaagtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccacttgcgtgggccatcggcggtttgctctctgttgcactggtcgtgggtttccccccccaggcgttacctggcaccctgccctatggagcccggactttcctcccctccgcccgtctccccgaaaggacgacgacgaagcggcgactgtctggtcagcttcggcgcgcagtatagagggttcgcgcgactttgtcaccctgcgctgcgcattcctatcgccagagcggcagcaacatttctggatgcccgataaatattgtcaaaagcgccccgaaaagcctcctccagcgtcacgatgcgcgtgagtacgctaaagacagcgtcgatgccataatgatgtactattcctacatcgtgcgtcaggctgccggcaatgccaatcactggcttatgatattttttcgccacattcgcgacgccaatcggcactttaccgcgaatgctttggctatcaatccgcccttctcccgtcaccaccagcgtacagtcgtggatatgctcctccaggttcagtgccgccgtgacaatttcgatcccgctgcgtaattccgcaccgagaaaagccattaacgccgcccccataccgcctgccgcgcctgcgccgggcgccgcctttacgtcgacattcagcgatttttttatgatgtcggcataatgagcaagattcctgtccagctcaacaatgttctcttcggtcgcgcctttctgcggcccaaaaattcgtgatgcgccattgtcgccgataagaggattggagacatcgcaagcgacacgaatagcgcagagttttaaacggggatcgagctctgaaatatcaatgttgcttagacaatgaaggcttccgccaccgtaaccaatatccgcgccgtttgcatcgcgcagttttgcgcctaacgcctgcatcatccctgcgccgccgtcatttgtcgcgctgccgccaatgcctataatgatattgcttgcgccgctttccagcgcctgcaatatcagctcccccgttccccgcgaggtagtaatcaaagggttgcgtttttctggcggaaccagcgccagtccgctggccgccgccatttcaataaacgcggttttaccatccccggacattccccagcaggctttcactttttcacccaacggcccggtcacccatgcggcgcgttcaacgccctgcgtcgcggcaatcatggcttcgaccgttccttcgccgccatcggcaaccggaacagagacatattgcgcatcggggaaaatttcccgaaatcctttttctatcgcctgcgctacctcggcggcagaaaggctttctttataggagtcgggggcaattacgattttcatagtggtagcctgttactgcacaacgccggatggcgtttcacttatccagcctgaaattcaggcccggatcgctacacgccatccgggcacaacgtcgttagcgagtgacttccactttcgccagtttttcgtagtagcacgccagcgcgctatggtcgtcattaccgtgtccatccgcgcgtaacgcctgcatcatttccataacggcggcggtcagcgggagctgcgcgccaacgccgtgggaggtatccagcgcattcgccagatctttaatgtgcagatcgatacggaaacctggcttaaagtttctgtccatgaccatcggcgctttcgcatccagtaccgtgctgccagccagaccgccacgaatcgcctgatagaccaaatccgggttgacgcccgctttagtcgccagcgtcagcgcttcagacatggcggcgatattcaacgccacgatcacctggttagccagttttgtgacgttgcctgcgccgatatcgccggtatgcaccacggaacccgccatcgctttcatcaggtcgtagtacttgtcgaaaatggctttatcgccccccaccatcaccgacagcgtgccatcaatcgccttcggctcgccgccgctgaccggcgcatccaacatctcaacgcccttcgccttcagcgcatcgctgatttcacggcttgccagcggcgcgatagaactcatatcaatcaatacggttcccggcttcgcgccttcgatgataccgttctcgcccagcgcaacctctttcacatgcggagagttaggcagcatcgtgatgatggcgtcacactgttcagcgatcgccttcgccgtagaggccgtttccgcgcctgcggcaatgacgtcggcaatcgcttcaggattacgatcggacaccaccagcgaataccctgctttcagtaagtttttgctcatgggcttacccatgatgcctaagccaataaagccaactttcatcgtcatagcgttctctctttccataccaggattattttttaaaggtgtcggcaagcttctgcgtgctggcgcggaatgcgcctaaatcgctgccaacggcgacaaaggtcgcgccccattccagataacggcgggcatccgcctctaccggcgccagaatgccgcacggtttaccgtgcgctttagcgcgggcgaaaatatgttgaatcgtctgctgcacgtcagggtgagaagcattgccgagatgacccagcgcggcggccaaatcgctagggccgacaaaaatgccatcaacgccttccgttgcggcgatggcatcaacattgtcgacacccaactggctttcgatttgaacaataatggtgatgtttttgttcgactgcgcaaagtaatcaggcaccgtgccgaacatattcgcgcggtgagaaacggagacgccgcgaatgccttccggcgggtaacgcgtcgaggcgacggcgcgagccgcttcctcttgcgtttcaacaaaggggatcaggaagttataaaacccaatatccagcatccgtttgataatgaccggttcattggttggcacacgtaccacaggcgcgctggcgctgcctttcaatgccattaactgcggaattaaggtggtcacatcgttcggcgcatgttcgccatccagcaccagccagtcaaatcccgccagaccgagtacttcggtggtgattgggcttgccagtgcagaccagcagccaatctgcacctgttgcgccgccagcgccgctttaaacttattcgggaaaatagcgttattcatcgcttataccttcgcttatttctttaattctctacatgtgatgccgccaccatgacttatagcaacgacaataaaaatgcttatttgaaatcagaatgggtctccacattctatttctaatgtggtacacatcctgtagcacaatataccgttctgatatctttatcgtcttttattattatcatgatattttcaaataactcgtcagatacactgaattcgccattcagtataaacagcctatgtcggataatcattgtgcaaacgctcattaaaaagggtttatttaacgcttatttttgagcatacgcccatgatactgggcgctaatgcacacatttacgctttgcctgccctacataaaaaatttcataatttgcggtgatctggatcacgttcttatatctatactcctgtcattcttatttcattatgcatgaactttatttcttatattgagatttaacgatttaaccataaccaaaatagataatcctatttctatcatccaggctggagaatgttgaacaatggccaatatcgaaattcgccaggaatcgccatcggcgttttatataaaagtacatgaaaccgataatgtcgcaattattgttaatgaccacggccttaaagccggaacacgttttccggatggcctggaactgactgaacatattccgcaaggccataaagtcgctctgacggatatccccgctcacggcgaaatcatccgttatggcgaagtcatcggttatgcggtacgcgacatcccgcgcggaagctggatcgacgagtcgctggttgaactgccaaaagcgccgccgctgaatacgctaccgctggcgaccaaagtaccggaaccgctgccgccgctggaaggctacacgtttgagggctatcgtaacgccgatggcagcgtcggcaccaaaaatctgcttggcattaccaccagcgtgcactgtgtggcgggcgtggtcgattatgtggtgaaagtgattgagcgcgatctcctgcccaaatacccgaatgtcgatggcgttgtagggctaaaccatctgtacggctgcggcgtggcaatcaacgcgccggcggcggtcgtgccgattcgcacaattcataatatcgcgctcaaccccaattttggcggcgaagtgatggtgattggcctcggttgcgaaaaactgcagccggaacgactgctggaaggcaccgaggatgtccccgccatcgccgttgaaaacgccagtattgtgcgtttacaggacgagcagcatgttggctttaaatcaatggtcgacgatattttgcgggtcgccgaacgccatctgacgaaactgaaccagcgccagcgcgaaacctgcccggcctccgagctggtcgtcgggatgcaatgcggcggcagcgatgcgttttctggcgtcacggcaaacccggcggtgggttatgcttccgatctgctggtacgctgcggcgcgaccgtcatgttctcggaggtcaccgaagtgcgcgatgccattcatcttctgacgccgcgcgccatcaacgaagccgtgggtaaacgcctactggatgaaatggcctggtacgataactaccttgatatggggaaaaccgatcgcagcgctaacccgtcccccggcaacaaaaaaggcggcctggcgaacgtcgtggaaaaagcgctgggctctatcgctaaatcgggtaagagcgccattgtcgaagtattgtcgccgggccagcgccccaccaaacgcggcctgatttacgccgcgacgcccgccagcgatttcgtctgcggcacgcagcaggtcgcttccggcattaccgtacaggtctttaccaccggacgcggcacgccgtacgggctgatggcggtgccggtcattaaaatggcgacgcgtaccgagctggcgaaccgctggtatgacttaatggatatcaatgcaggcaccatcgccacgggtgaagagacaatcgaagatgtgggctggaagctatttcactttattctcgatgtcgccagcggccggaaaaagactttctcagatcaatggggattgcataaccagctggcagtgtttaaccccgcacctgtgacctgatctattctggaaagcgcctcgcaaaacatggcttaagggccatgttttcatatgtttgataaactgcgccatgttcataccggatatggcaaaaacacctaacccaccataaaaccattcaaattcaataaattgaaattctatgccaggcgcaaccttacgtttctcactaatttgagtcgcagcacatgcaatttgaggtatgtcgaatataacgacagcctattaatcacctttacttaattctgctgcctcatcaattctttaatttgtgccagcgtggacgtgccttccatcggcccacgcgcagagatagccagcgatcctgcggcattagcatgggctaaagcatcgggtacggaatatcccgcaagaaacaggctgacaaaggttgcgccaaagcaatcgccagcgcctgtaggatcaaccaccttcaccggatacccagccacatgatgttgttcgtcttttgaatagtaactggctccacgggcgccacgtttaatgatgacatgggcaattccacgcttgtgaagccttgcgacaattttctcttcatcgcgggatttgctcaggccgaaataatccagttcgccatcgcttggcaggaagaaatccgtgtaatcaagaatatattcaaaggcctgcgacatttcgcggatctttagcatctctttacggatattaggatcgaaagaaattgtgccaccattttcttttacaatgctaatcgccttgcgtacggcatcgatcaaacgaaaggaaaataatgacgatcccataatatgaaagtggcgatattgcctgagtaatgtttcatcaaggtggtcggcactcagcaaaccgcacgcactgtccggcatgttgaaaataaaatctcgctgggcctggcttcggtagctgacaaaagcactacctgttgtggcgttcggcagtacggaaattccctgtacatttacgccatcgcgcgacaatcgggtaatattcataacgccaaaggcatcgttgccaacacagctaaacaacaatgaacgaaaaccaagtttagcaacctgatcggcaaatatggcaggcgccccactgggatacggcccccaaaattcccccggtgaggaaaatccctggttctctttttttgccagaaactcgacgagcaattcactcaatgttgcgattgttatgttcatgcgttgtccttcatcttgcctgatgcagggtcgggtttatccaggtcagacattcgttattggtatagctgttggttaagccgtcggccagaaaccgtgagtggtactcagcggcgacaatctgtggcgtaataatcgcgctcagcgtattcagttttcctaccggataacgcgctatatcatgaatcggacgctgcgccaccacggcaatactctgtccactaaggcgcaggcattcacttagcaaagcagctgcactttcgtttttcacgttgagcgtgccatcctcgctgatatggtccaccatcaccagacaacatgacggttgaaattgttgcaaagattggatggcgatttcgccccccagcgcctgaccactgcgccccagtacaccgcccaacaacacaatttcaccatcgatataatcacgggccggtgcaacatggctaagatcgttgatgataaggcacagatcccgataatcgcccaggaaaggaagcgctttacgcaacacctctccggcccccagaaacacggtatcgtcgtcgcagaccagacgggcaacttgcttagccagttcaagctcgacgctatgctctaacgcctgcgactgcaccacttcatggcttaccgctgctctgacgggttgggccgtgtaaatcgctccgccaaaggagcgtttcagatagccttgctgctccaggtaattgagatcattacggatcgttacccctgaaaccgataacatttcagccaaatcgtctacttttatttcgccgtttttacggacgatttcggcaatgtccagacgccttttcaacaggctggtagatggttttgccacaacataccctttttttccgcttcgtcgggaagttatcccgtgctttaactttcatttttaaacttctgacaggggatgtcaattttgcaccacgtcaccgaatgctcaatgggaaacatcacaataaaatcaatcacttatagaattttcacatcccctatttacttacaaaacaaaatttaaatccacatatttgctttcatttaagaaaaattatcctgcttttgtgttgatgatcacaatcatgtgtggcaatgatcgttacattactttcaaaacgaaggttatttttattttgtactttaatttcgaaagttataaacggagaccactatgttcattatttccagtaaaaatatgctccagaaggcccagcatgcaggctatgccgtgccagcctttaacatccataacctagaaaccttgcaggtggtggtagaaaccgccgcagaaatgcgctcaccgctgatcgttgccggaacaccaggcacgtttagctatgccggaatgggtaacattgtggcgatcgcgggcgatctggctcgtgaatacaatctgccactggccattcatctggatcatcatgaatcgttagccgatattgaaagcaaagttatggcagggatccgttcagtcatgatcgatggttcccactttccctttgaagagaatgtggcgctggtgaaaagcgtggtcgatttttgccatcgctacgacaccagcgtggaggcagaactgggccgccttggtgggatcgaagatgatttagtggtagacagcaaagatgccctttacaccaatccacagcaagcacgtgagtttgtggcgcgcaccggcattgattcgctggcggttgctatcggcacggcacacggtatgtatgccgctgaacctaaacttgattttgagcgactggcagaaatacgcgctctggtggatatccctctggtattgcatggggcatctggtttgccggaaagcgatattcgccaggccatcagccttggggtatgcaaagtcaatgtcgccaccgaactgaaaatcgccttctccgacgccttaaaagagtatttcctacaaaacccgaaagccaatgatccccgccactatatgcaaccagcaaaacaggcgatgaaagaggtggtacgcaaagtaattcatgtttgcggctgtgaagggcaactgtgaggaatcgcctgtgatctacacgctaacacttaatagcgcgattgatatgaatatatttagcgatcctttacagccaaatattgtcaatcgcactcaccacaccgagttttgcccaaatggtaaaggggtaaatgttgcgctggttctggatcactttcaaatacctgcgcatatattaggcatttttggtggtttcaccggacattatattgtagaaagcctgcgtacccgaaaaatgccagtcacaccagcatgggtagaagaacccacgcggattaatattttcattcatgacggcaagcaggaatataaactggtcaaccctggctcatatattccagatgaatgtaaaaaacaaattatcacgattatttcgcaactgcccgatgcagaatatctggtgataagcggcagcctgccacaaggtattgaaagtcgcttttacgcagaaattatgcatatttgtcagcaaaaaaatatcggcgtaattttagatattagtcatccgtcattacgtcagttactggagttcaaaccgttattaattaaaccaaatgatgaagaggttaaagcaatattcggtttaactgtctctgacgacaatgatgcgaaaaatactctaaccactttacatgcacttggtgcacaaaatgttctgctaacccttggcgctaaaggaatgtatttctccaatgggattgattactggttttgtagcgcgccaacggttgatttggtgagctccgcctgtgcaggcgatgctgcactggccgcctttctcagccagtggttatctacaggagaagtggaatatgccttatctcttgccagtgcaacaggagctgatgtcgcaagttctgccggactaggccaacttgcggcaatagaaaccttactttcgcaaatccacgtcagaaagctgtaggttaaattacaatataagttctgcttatgaaaaagatcattgcagtgaccggctgccctaccggtattgcgcatacatttatggctgaagaagccttaaaaaatgccgcgaaaaaattatctgttgaaataaaagttgaaaccaatggtgccagcggtgttgaaaatgccattcaacctgctgatctggtagatattgccggagtcattattgcggcggataaagatgtcttacctgatcgctttaatggtttaccggttattgaagtaccggtaaaagaagcaatccatcatcctgcggagctgattaacaaagttattaatggtgaagccccaatacgtaaaggcgaatcaaccaccagcacggaaattatcgaaaaagaatcactggggcgacaaatttataagcacctgatgagtggtgtttcaaatatgctaccttttgtagttgccggaggcatattaattgcggtgtcgcttttatgggggatttattccgctgatcctaattcagctgaatacaatgcaaccgccgcaatgctaatgaaaatcggtcagcaagccttttcgattatggttccggtctttaccgcttatattgcattctctatttctggcagaccagggatggtggctgggtttgtcggcggcttactggcaaatactaccggagcaggatttctcggtgggataattgccggattcgccgccggttacctgatgttatgggtaaagaatcgactcgaaggcttaccgcgtcagtatgaaggcctgaaatcgatttttattatgccgctcattggcgtactggttattggcgtgttgatgtcgctgcttgggcaacctgtcgcagctatcaataatagcatgatgaactggctggcatcgctacaggaagcgaatccaatattgctgggtattgtggtgggtgcaatgtgctcttttgactttggcggcccggtaaacaaagccgcttatgtcaccggcacgcttttactgggccagggcaacttctactttatggctggtgtgtctgccgcatgtattactccaccactggtaattgctctggcgaccaccttctttccaaaaggttttagcgaggaagaacgtgccgcaggcatggttaactatatcctcggttgtacacacatcactgaaggcgcgattcctttcgcagcgaaagatcctttgcgtgtcatcccgatgatgatgattgcttccagcatttccgcagtacttagctacagcttgcgtattcaggttccggctcctcacggcggcttcttaattttacctttggtgagtcagccgctggcctgggtgttatgtatccttgcgggatctgcatgtggtgcgatgatgcttggcctatggagattgtgggctgtgcgcaaaaattcagtcaacacaactcctgtagcaaaggctggaggtcagaatgcagctctgtgaacacgatatttttatcagcgatgagcgcctcgataaagtcaccgctctgcaccgcgtggtggaaaagttatctgcggctggcaataccacgcctgactatttacgcggcatgttggatcgcgaagcacagatttccacttatctgggaaatggaatcgcgatcccacacggtacgccagaatctcgcgatgcggtattacaaaccggtgtaaaggtaatcgtttttcgccacggcgttgactggggtgacggcaataccgcgtatctggtcaccggaattgccgcgcgctccaatgaacatcttgagattttgcgccaactgactcgcgtgctcagcgatgacgctattctgcaagcactggctaaagccgaatcccccagtcaggttttagcgctactgactggctcgacgaccaatacgccagcagccatggagttgcacgagggtgagcaggcaacatttgtcatccataatccgcatggtttacatgccagacccagtgcggtactggtgaagtttatcaaacagtttcaaagccacattacggtagaaaatctggataacgcctccggcccggtggacggaaaaaacctgatgcgagtggtgtcgctcggcgcgaaaaaggggcatcgcttgttgttccgggcgcagggcgaagatgcacagcaggcactacgtgaaatcggggagcttatcgcctctggtgcaggcgagatgatcaccgttcccgttaccccaccaccagaagtcatgcagccaaagcgcagttggctatctcgattgtttaattagccttcatttgttcctccgtgcccgctccggcgggtacggtttttcatgacaaagtgaagttacagacattacacaccatttcgttaccttacattttctttcgcaactttcatttatcagatcaaaatcacaaaacaacattacgaaagcctataaattctttcgaagaataaaaacgaaagaactcggagataaaagtgaaagaaataattgctcgtcataaagcaggagaacatctgggcatctgttcagtttgttctgctcatcccctggttatcgaatcagctctgcttttcgatctcaatactgacaacaaggtattgattgaagccacatccaatcaggtgaatcagtttggcggttataccggaatgaaaccggctgattttcgtgattttatttatggcattgctcaggaagtgggatttccacgtgagcggttgattcttggtggcgatcatttagggcctaactgctggcagaacgaaccggcagcggcggcaatggaaaagtcggttgagttaataaaagcgtatgtcgccgctggttttagcaaaattcacctggacgcgtcgatgtcctgcgctgacgacccgacaccgttggatccgatggtcgttgcacgccgtgccgccgtgctttgtaaagcagcagaagagaccgcaaacgaagaacaaaaatgccatctgacttatgtcatcggcacggaagtgcccgttcctggcggtgaagccagtaccatcggcagcgttcatgtcacccgcgaggtcgatgctgcccgtacgctggaaactcaccaaatcgcgtttcgtgaatcaggtctggaagaagcactgtcacgcgtgatcgccattgtggtgcaaccgggcgttgaatttgatcatacccagattattcattatcagccgcaggcggcacaggcgctctccgcatggatcaaagaaacgccgatggtctatgaagcgcattcgactgattaccaaactcgccaggcctaccgcgccctcgttcgcgatcattacgccattctgaaggtcggccctgcactcactttcgccctgcgcgaagccattttcgcacttgcgcaaatggaaaacgagctgatctccccggaacaacgtagccgcgtgatggaagttatcgatgaagtgatgctaaacgagccaggctactggaaaaagtactaccgccccacctagagccaggcgatggtcgacatccactttagtttgtctgaccgtattcgctattactggccgcacccgcgtattcgtcaaagcgtagagaagttaatcgccaatctgaataacgtcacattgccgctgggattaattagccagtttatgcccgtacagtttgaacgcctgtctgagggcgtgctcacccccacgccgcataacctgattattgacaaaattcaggatgttctgcgcgcttatcgcttcggttgcacgccggatgtcgcctgaatagtggagaatttatgagccaattatttgtccgaaccggaatcacattcgactcgagccaacaggcgctggcgcacattggcaaagagatgctggcgaaaggcgtggtacatgatagttatccgcaggcactggtggaacgtgaagcgtcctttcccaccggcattgcgctggagcgccacgccgtcgctatccctcattgcgaggcagttcatgcgaaatcacccgctatctatctgattcgtccagataagccggtcatgtttcaacaggcggatgatgacgaagagattgccgtttcgttaatcatcgccttaatcgttgaaaacccggcggcacagctaaaacttctgcgccgtctgttcggggcattacaaatcccggacaccatagaagccttactgagcgccccggatgccgaactggcgtcgtgctttgagcacaaagtccttacggctgagcagtgcgtccaggtttaataataaattgataataatgaggaataccctatgaaacgtaaagtaattgtggcctgtggcggtgcggttgcaacctcaacgatggctgcggaagaaattaaagagctatgtgatgccaaccatattgagctcgacttagtgcaatgccgggtcaccgaaatcgaaacctatatggacggcgccgatcttatctgtaccactgccagggtcgatcgcgcctttggcgatattcccgtcgttcacggtatgccttttgtttccggcgtgggtattgaagcattacagcaaaaaattctgtccattctcatggggtaacgtatgtttagcgaaataatgcgttatatcctcgacttaggcccaacggtgatgttgcctctggtgatcatcgtgttctctaaactgctgggaatgaagcttggggattgttttaaatcgggtttgcatattggtatcggcttcgtgggtattggtctggtcatcggcctgatgctggattctatcggccccgcggcgaaagccatggcggaacatttccaaatcaatctccacgttattgacgtcggctggccgggttcatcgcccatgacctgggcgtcacaaatcgcgctggtcgcgatccctgtcgccatcggggttaacgtcctgatgctggtgacccgcatgacccgcgtggtgaatgtcgatatctggaatatctggcacatgaccttcacgggcgccatgctgcatctggcgaccggttcatactggctggggattctgggcgttgtggttcatgccgcctttgtctacaaactgggggactggtttgccaaagatacccgcgactattttggcctcgaggggattgctatcccacacggctcatccgcgtacctgagccccgtggcggtgctcgttgataccattatcgagaaaattccgggtctcaatcgtattcactttagcgcagacgatgtccagaaacgcttcggaccgtttggcgagccggtgactgtcggcttcgtgatggggctggtgattggtgtactggcaggctacgacaccaaagccgttctgcaactggcagtcaaaaccgcagcggtgatgctgcttatgccacgcgtcattaaacctattatggatggcctaacgcctatcgccaaacatgcgcgtaaacgtctacaggccaaatttggcgggcaggagttcctgataggccttgatccagcgctactgctcggtcatacctctgttgtctccgcgagcctgatattcattccgctgaccatcctgattgccgtcttagtaccggggaaccaggtgctgccgttcggcgacctcgccaccatcggtttctttattgcgatggcggttgcggtacaccagggcaacctgttccgcacgctgatttcaggtgtcattattatgggtatcaccctgtggatagccacgcagacgattggcctgcatacccaactggctgccaatgccggagcgctaaaagctggcgcacaagtcgcctcgctggatcagggcggttctcccatcacctggctgctgattcaactttttacctggcagaatatcgtcggcttcgccgtcattgccattatctatctggccggcgtactgctgacctggcgtcgcgcccgacagtttgtcgcggctgagaaagccacggcgctacagcaaagtcaaatcgcctcttaattttaggggagcaatcgctcccctcaccttcctggagaatgttatgaaatcagtggttattcacgctgagggagacgtgcgcgttgaagaacgtcccttaccacaactgcaagccgaggacgatgtgttggtcaaagtcgttagctcagggctttgcgggtcggatatcccgcgtattttcgcgcagggcgcccattattatcctattacgttaggccatgaattcagcggctacgttgaatcctacggcacaggcgtaacggatatgcagcctggcgatgccgtcgcttgtgtcccgcttcttccctgctttcactgtccgcaatgcgaacgcggttacttttctttatgcaaacagtatcagtttgtaggatcgcgcagcgaaggcggtaatgcggaatatgtggtggtcaaacgggccaatcttttccgcttgccgtctgatatgccgattgaagatggcgcgtttatcgaaccgattaccgtgggcttacacgcctttcatctggcgcagggctgcgaggggaaaaacgtaattatcgtcggggccgggacaattggcctgctggccttacagtgcgcgcgggaactgggcgcgcgaagcgtaacggcgattgatatcaatccgcagaaactggaactggcgaaagcgctcggcgcaacgcatacctgtaatagccgggaaatgaccgccgacgacatccagaccgcgttgtccgacattcagtttgatcaactggttctcgaaacggcaggaactccccagaccgtctcgctggctatcgatatcaccgggccgcgcgcgcaactggcgctggtggggacgttacatcacgatctcaccctgacgacgcgtacattcgggttaattttgcgtaaagagctcacgctcctcggcagttggatgaactactccgcgccatggccaggagaagaatgggaaaccgcagcgcgcctgttggctgaaaaacgtcttcaactgacccctctcattgcccatcgcggcgatgcggaaagctttgcagaagcagtcaaagcgcttaatggcgcgcccatgcagggcaaaatcttacttcaactttcctgatggtacgagccagcaacctgcgctggctcacatttcctttcgaaatttagcgttcacctttcgcaatccttcgtttaaactagttacagttaattatcaggcaaatcaatatgaactcatttgagcgaagaaataaaattgtcgacctgattaatacgcaaggcagcgtgctggtgatggacctttcaaatacctttggtatttctgaagtgactatccgtgctgacctgcgtctgctggaagagaaaggccttgtcacccgttttcatggcggcgcggcaaaaccgggaagtcatctggcggaaggcgacaatcaggaagtcattctggaagatcggtatcaactcgccagcgatccgaaaaagcggattgcccaggcggctgcggcaatggttgaagaaggaatgaccatcattctggatagcgggagcacaacattactaattgcggaagcgctcgcgcgaaaaagcaatattacggtgatcactaacagcttgcctgccgcttttacgctatcagaaaataaagatctcacgctggtggtttgcggcggtacggtacggcataaaacccactcaatgcacggcacgattgcggaacgatcgctacacggcatcagcgccgatgtcatgtttgtcggggcggatggcattgatgcgacaaacggtattaccacgtttaacgaaggttattccattagcggcgtcatggcggcggcggcgcacaaagttatcgcggtactggacgcgaccaaatttaaccgtcgcggctttaaccaggtattgccgatggacaagatcgactgtgtgataaccgatgacaccatcagcaaacaggataaagcggcattagcgaaaacaggcgtggaattaatgatcgtctaaaaaggagtcggttatgcattgctgatcgcgagagtaagcccaaaggaaaggtccggcccgctatcaccgcccaatgcccccatcactttacccacatcaatcacctgattgagtattaacgtgatggcgataaaaggcggttcccgggcgctcgcttttactcttcctgctgcgccagcgcatacttatacagcgcatttttcttcacgccgtgaatttctgctgccagcgccgccgcttttttcagcggcagctctgcctgtagcagcgccagcgtgcgcagcgcgtcggcgggcaggtcgtcttcttgcgctttatgcccttcgacaatcagcaccatttcgcctttgcgacggttttcatcttctttgacccacgccagcagctcgccgaccggcgcgccgtgaatggtttcccaggttttggtcagctcacgcgccagcaccacgtaacgggattcgccccacacggccaccatatcttccaggctatccaacagacgatgggtggactcataaaaaatcagcgttcgtggctccgcttcaatggcttttagcgcatcacggcggccttttgatttggcaggcaggaagccttcataacaaaaacgatctgatggtaaacctgcggcgcttaatgcagtgatagcagcacacggccctggtagcggcaccacgcgaatccccgcttcacggcaggtacgtaccaggtgatagccggggtcattaattagcggcgttccggcatcggaaaccagagcaatgttctgcccctctttcagcttcgcgaccagcgtttccgctttttgttgttcgttatggtcgtgcagcgcaaacaaccgggcattaatcccaaaatgttgcagcaataaaccggtgtgacgagtgtcttcagcggcaattaaatcaacggcttgtaaaacttccagcgcgcgttgggtaatatcagccaaattcccgataggagtaggtacaataaagagttggccctgagaattatccgccgattcgttttgtttcattgtgtcgtccgtattgccgatttaatattgagcattgcgtaaaaaaatatcactggatacagtatggtaccctcaacattttctcgtttgaacgccgcgcgcgcgctgcctgtcgtcctggctgcgctacttttcgccgggtgcggcacccaggcgccagatcaaagcgcagcctatatgcagggttcagcgcaagctgattccgccttttacctgcatcagatgcagcaaagcgcagatgatagcaagaccaactggcaattactcgccattcatgcactgctgaaagaaggaaaaagccagcaggccgtcgagttgttcaatcaacccccgcaaaatctgaacgatacccagcgtcgcgaacaatctttattagcggtagagatcaaactggcgcagaaagatgtggcaggcgcgcaggccttgctggataaactaaaacccgccgactttgcgccacatcagcaagcgcgttactgacaggcgcagatcgttgccagccagggacgcccgtcgcttaccctgttgcgggcgttaatcgcccaggaaccgctactggcggcgaaagagaaacaaaaaaatatcgacgccacctggcaggcgctctccgccatgacgccggatcaggccaggacgttagttatcaacgccgatgaaaatgtgcttcagggctggctggatctgcaacgcgtctggtttgacaaccgcaacgatccagacatgctgaaagccgggatcgccgactggcaaaaacgctacccgcaaaatccgggggcgaaaatgctgccgacgcagctcgtcaatgtacaacgttttaaaccagcttccaccagcaaaatcgctctgctgctgccgctgaacggtcaggctgccgtgtttggccgtaccatccagcaaggtttcgaagccgcgaaaaacctcggcacccaggcggtggaaatgcagcctgtcgccgcgcctgacgcgccggtcgaaccaagcgtggaggagacgcaaccacaaatgaccaacggcgtcgccagtccgtcgcaggcctcggtgagagatctgactgatgacgctccatcccagtctgctacgccagtcagcgcgccacaaactccccctgcgcagcctgctacagcaagcgcgccggcggatccctccgctgaattaaaaatctacgatacctcttcccagccgttggatcaggtgctcgctcaggttcagcaagacggcgccagtatcgtggtcgggccgctgttgaaaaacaatgtggaagcgctgatgaaaagcaacacgccgctcaacgtgctggcgctcaaccagccggaaacggtacgtagcttccctaatatctgctatttcgcgctctctccagaagatgaagcccgtgacgcggcgcatcatatttatgagcagggcaagcagtcgccgctgctgttgatcccacgcagcgcgcttggcgatcgcgtggcgaatgccttcacccaggagtggcaaaaactgggcggcggcatcgtgttacagcaaaaattcggctccgtagccgagctgaaaatgggcgtgaacggcggcgcgggtatcgcgttgacgggcagtccggtcgccgccagcgtgcctgcgcagccgggcgttaccattggcggtctgaccatccctgcgccgccgaccgacgcgcaaatcaccggcggcggacgcgtagacgcggtctatattctggctacgccggaagagattggctttatcaaaccgatgatcgccatgcgtaacggcacccagagcggcgcgacgctgtatgccagctcccgcagcgcgcaaggcacctccggccctgacttccgtctggagatggaaggtttgcaatacagtgaaattcccatgctggcaggcggcaatacgccgttgatgcagcaggcgctgagtgctgtacataacgactattctctggcgcggatgtacgccatgggcgtggatgcctggacgctggcgaaccacttttcgcagatgcgtcaggtgcaggggtttgagatcaatggtaataccggcgcattaaccgccagcccggattgtgtgattaacaggaagttatcatggctcaaataccagcaaggggagattgttcccgccagctaacacgtaaacaggctggcgacgcgtgggaagctgccgcgcgtctctggctggaaagcaaaggactgcggtttatcgccgccaacgtgcgcgagcgcggcggcgaaatcgatctgatcatgcgcgacggaaaaacgacggtttttgttgaggttcgctatcggcgctccgggctttatggcggcgcggcggctagtgtgacccgcagcaagcaacacaaattattacatactgcccgcttgtggctcgcccgccagaatgggagttttgatactgtggattgtcggttcgatgtgttagccttcaccggaaatgagattgagtggtttcgggatgcgtttaacgaccactcataattgaagattttaaggattagcgtgctcgaaagaatcaaagtttgctttacagaaagcattcaaactcaaattgctgcggcggaagcgcttccggatgccatttcccgcgccgccatgacgctggttcattccctgcttaacggcaacaaaatcctctgttgtggaaacgggacgtccgcggccaacgcacagcattttgctgccagcatgattaaccgctttgaaacggagcgacccagtttacccgccattgcactaaataccgataatgtggtcttaactgcgatcgctaacgatcgcctgcacgatgaagtttatgcaaaacaagtccgggcgctgggacatgcaggcgatgttttattggcgatctctacgcgtggtaatagtcgcgatatcgtaaaagccgttgaagcagccgtcacacgtgacatgaccattgtggcgctaaccgggtatgacgggggcgagctggccggactattagggccgcaggatgttgaaattcgtatcccttcacaccacagcgcgcgcattcaggaaatgcatatgctgacggtaaactgcctgtgcggtttgatcgataacacgctttttcctcaccaggatgattaaggagtacacatgaaggcattttcgccgctcgcagtccttatttctgcgttgctattgcaaggttgcgtcgccgccgcggtagtgggtacggcagccgtcggcaccaaagccgcaaccgacccgcgtagcgtgggcacccaggtggatgacggaacgctggaactgcgtgtcagcagcgcgctgtcgaaagatgagcaaatcaaaaaagagacgcgcatcaatgtcactgcttatcagggcaaagttttgttagtgggccagtcgccaaacagcgaactctccgcacgcgcgaaacagatagcgatgggcgttgaaggcaccaccgaggtctataacgagattcgccagggtcagcctatcggcctggggaccgcctctaacgatacctggatcaccacgaaagttcgctcacagctactgaccagcgatcaggtaaaatcgtcaaatgtgaaagtcaccaccgagaatggcgaagtgttcctgctgggcctggtgactgaacgtgaaggtaaagcggcagcagacatcgccagccgggtgagcggcgtgaaacgcgtgaccaccgcctttacgtatattaagtaaccggtgtgccgggtggcgataaaaatgtgtaaatcgcgtcgccatccggtaaatcatccggcttcgctaccccgctttttcccgcagttgcgatgaggtcagaatcgtcacgccttcttgtgctggctccagcgcttccgccagcatggcccgcgccacatcccgcgcatcgatcgatttccagtttcctggcagcagccggaatagcggagcgaaaagcgtttcattcacccgccgcgttgttctgtcgccgagcagcatagaaggccgggcaatcgtcaaacgaggccaattttgcgcgattaacgcctcctccatttctcctttcacccgattgtagaaaaacggagagtgcgcgtttgctcccattgcgctgaccaccaacatgtgctgcgcgcccagtcgacgcccggtcagcgcggtatcaaccaccagcgtataatccgcatgaataaacgccgctttacttcccgcttcacgccgggtcgtgcccaggcagcaaaaaacaatatccaccgggtcggtcacctgagctaacgcgtcggtaagctgcggatcgtgagggttataaacgccgacaatatccgtcagcgggcgacgcgttggcgcggcgatcgcgctcacctgcggcgtgttgattaacattctcagcagatgtccgccgaccagtccggtcgcgccggtaatcagtacctgactcatcctcgctcctttacagatttgtccaccttgcactctcggccctatcgaccaggcttaatagtctacgaggtaagtatccatcattgtggaaaatttgccttacccgacgccaccactgcggaggaaacgcatgagtaagaaaattgccgttttgattaccgatgaatttgaagattcagaatttacctcgccggctgcagaattccgtcaggccggccatgaggtcatcaccatcgaaaaagaggcgggtaaaacggtgaaaggaaaaaaaggcgaggccagcgtcaccattgataaggctattgatgacgttcgtcccgacgagttcgacgccttgctattgccgggaggtcattcgccggactacctgcgcggcgacagccgtttcgtggattttacccgcgatttcgttaacagcggtaaaccggtttttgccatttgccacggcccgcagttgttgatcagcgccgatgtcattcgtggccgcaaactcacggcggtgaaaccgattattatcgatgtgaagaatgcgggcgcggaattttacgatcaggaagtcgtcgtcgataaagatcagctggtgaccagccgcacgcctgacgacctgccggcatttaaccgcgaggcactacgcctgctgggcgcgtgagtcacgtaaccagtgcagttttttaccaaaccccagcgtgttgtcggtgaatttaatttcatccagccgaatttcccataccggcgctggcagcaccctggcgaccgggaagcgacgaagataagctttacgcgcggcgtcgctctcctgcccctccagacggcgaatttcccctttaaactgcacgccgcgaatgcgcgccaccgttttcggctgaccattgaccgttcccgcaactggcgcgcacgcgccggacatttgcgcatggcgggttttatcatccgttaacagatacagcgcgacgttttgcgcatcgaacaaataaaacgcattggcgcaccacagctctccctcatggtgtacgcaccaggtcaccacgtgttgtttcgccagccaacggccaatagcggtaagtgtgtccatctttattctcgcttatactgggaacctgaaaattatcatgctgatggcgacaatgacaccctggtatctgtatctgattcgtactgcagacaatgcgctttacaccggaataaccaccgatgtggcgcgtcgttacaggcagcatcaaacgggaaaaggcgcaaaagcattacggggaaaaggcgagttaacgctggcgtttgcggcgcaggtcggcgatcgctcgctggccctgcgcatagagtatcgcatcaaacagctcacaaagcgccagaaggagcgccttgtgacggaacgcgaagcgtttgaggcgctgctgtccagcctgcaaacgccggtgcttaaaaacgattgaagtggtcgtgatactccaccagccccgtcacgccctccagcgcatcctcagccaaacggtgtacctggaaagcgctttccgtaccgggccaacggcagtgaagatcgtaatgtgcggccagttcaaaaccgaagcggctatataacgccgggtcgcccagcgtcacgaccgccgcgtagccgaactcgttgagcgaatccagcccttcatacactaactggcgcgccagcccttgcccgcgatacttttcatcgaccgccagcggcgccatgccgacccactgtaaatcttcgccctgcacatcaaccgggctaaaggcgacatagcccactacctggccttcatcatccgtggccaccagtccgagcgtcagaaaaccatcttcacgcaaatcgtgaaccagcttcgcttccgcatcgctttcgaatgaacggcgtaacagcgcatcaataccaggcgcatcaatgggaatttctactcgaattagcatggttcacctaccgaggtctgtttggtttccggcgagtttttcattcccgcctcaacaaaatccgccagttgcagcagcataatgcgtaacgctttcggcatctgctccagttcgatggcgtccatcagattcttcacatacaaccctaactcagtatcgccttcaatgaccagtcgacgctggaaaaagagcgtatccggatcctgtttacgggcggcgatcattagcagatcgctggcgtcggcgctaaaactgacgtcagcatccgcctgctggctaacgatcagcttttcattttcaaccgtggtataccattttaagtcgatgtcacgaacatgaatgcttaaccaacgaccttcgaggaattccagctctccatcggccagcgcctgacgaaactgccagctcagaacctgttccagaacctggcgctttagcgcaaagggcgtcagtttaaccggtacactcatcagagacgggccagcatggactaagcgtgaacgcagtttatctaacacgagctttactccctgtttcaatagtcctgttattttgccatatccaataaatcacatggcggcgtaaatcaacaattgggtctgattttctaccccattattggtgttaccaatacgcctttaactgccttaaatcaaaaattgtcgcagcaaggttaactaaaatccctgttcgttaacaattttgcgtcgcagacgtaaccctcaggataaattatggagctgctctgccctgccggaaatctcccggcgctgaaggcggccatcgaaaacggcgctgacgccgtttatatcgggttaaaagacgataccaatgcccgtcattttgccggccttaactttaccgaaaaaaaattgcaggaagcggtgagttttgttcaccagcatcgccgcaaattacacatcgccattaatacttttgcgcatccggacggctatgcccgctggcagcgcgccgtggatatggcggcgcagcttggcgccgacgcgctgattcttgccgacctcgctatgctggaatatgccgcagagcgttacccgcatattgagcgccatgtttccgttcaggcctcggcaaccaacgaagaagcgattcgcttttatcaccgcaactttgatgtccaccgtgtagtactgccgcgtgtactgtcgattcaccaggtaaaacaactggcccgcgtcacgccggtgccgctggagatattcgcgtttggcagcctgtgcattatggcagaaggtcgctgctatctttcttcttacctgacgggggagtcgcccaataccgtcggcgcctgctctcccgcccgctttgtccgttggcagcaaacgccgcaggggctggaatcgcgcctgaatgatgtcctgattgaccgttaccaggatggcgaaaacgcaggctacccaacgctgtgtaaaggccgctatttagtggacggcgagcgctatcacgcgctggaggagccaaccagcctgaacacgctggaactgctgccggagctcatggcggcgaacatcgcttcggtgaagatcgaaggccgccagcgcagcccggcctacgtcagccaggtggcgaaagtgtggcgccaggcgatagatcgctgcaaagccgccccgcaaaacttcgttccacagcgcgactggatggagacgctcggcgcgatgtccgaaggcactcaaaccacgcttggcgcatatcaccgtaaatggcagtgagaggagctatgaaatattccttaggaccggtgctttattactggccgaaagagacgctggaagatttttatcagcaggccgcaaaaagcagcgctgatatcatttatctgggcgaagcggtgtgcagcaaacgtcgcgcgactaaagtcggcgactggctggaaatggcgaaatccctcgctgccagcggtaagcaggtggcgctctccaccctggcgctggtacaggcgtcatctgaattaagcgagctgaaacgctatgtggacaacggcgattttctgctggaagccagcgatcttggcgtggtgaatctgtgcgccgagcgcaaactgccgtttgtcgccggccatgcgctgaattgctacaacgcggtcacgctgcgccggttgctgaaagaaggcatggtacgctggtgtatgccggtggagctctcccgcgactggctggtgaatttgcttaatcagtgcgatgaactgggcatccgcaatcagtttgaagtggaagtgttgagctacgggcatctgccgctggcctactccgctcgctgctttaccgcccgttcggaagaccgcccgaaagatgaatgcgaaacctgctgtatcaagtatccaaacggtcgtgacgtgctctcgcaagagaatcagcaggtgtttgtgcttaacggtattcagaccatgagcggctatgtctataaccttggcaacgaactgacgtcgatgcagggattggtcgatatcgtgcggctgtcgccgttggggacggagacatttgccatgcttgatgcctttcgcgctaacgaaaacggcggcgcgccgttaccgcttgccgcccatagcgactgtaacggctactggaagcggctggccgggctggagctacaggcctagccggatggcagcatcaataccttatccggcctacaaatagcgctcccgaaggcccgataagcgcagcgccatcgggcattgtttttgccattagtctcataaagctcactttgttaacaacattcgctaatctttaatgcagtattaaaagattaatcggtaacaaagtgagccgttatgactgacaaaactattccgttctcggtgctggatctggcgccgatccctgaaggatcttcggcaaaagaagccttcacgcactcgcttgatctcgcacggctggctgaaaagcgtggctatcaccgctactggctggcggaacatcacaacatgaccggtatcgccagcgcggcgacctcggtattgattggttatctggcggccaataccacaacattacatcttggctccggcgacgtgatgctgcctaaccattcaccgctggtgattgccgagcagttcggcacgctgaatacgctctacccgggacgtatcgacttaggattgggacgcgcgccgggtagcgatcagccgacgatgcgcgcgctgcgtcgccatatgagcggcgatatcgataactttccacgcgatgtcgcagagctggtggactggttcgacgctcgcgatcctaatccgcatgtgcgcccggtgcccggctacggcgagaagatcccgatctggctgttgggctccagcctgtatagcgcgcaactggcggcccagcttggcctgccgttcgcctttgcttcgcatttcacgccggatatgttgttccaggcgctgcatctgtaccgtactcagttcaaaccttcagcgcggctggaaaaaccgtacgcgatggtgtgtatcaatattatcgccgccgacagcaaccgcgacgccgaattcctgtttacctccatgcagcaggcttttgtgaagctacgccgtggagaaaccggccaactgccgccgccgattgagaatatggaaaccttctggtcgccatccgagcagtatggcgtgcagcaggcgctgagtatgtcgctggtcggcgataaagcgaaagtccgccacgggctggtgtccattctgcgggaaacccaggcggatgaaattatggtaaacgggcagattttcgaccaccaggcacgcctgcattcgtttgatttagcgatggatgtgaagcaggaattgttggggtagcgcattgttttgcccggtggcgcttcgcttaccgggcctacagcatcaagtaggccggataaggtgcaaccgccatccggcacaataacgttactggtacaccggcagcaaattaaagctcgacagaatatggataaccgcgttgccgacaccgaagaccagaatcagggcaatcatcggtttaccgccccagacgcgaaattttgggctgccgaaacgttcgcgagatttgcgcgccaacagcgcaggcacaatggccgcccagatagttgcagctaaacctgcatagccaatggcgtacagaaaaccgttcgggtacagcaggccaccaatcatcggcggcaggaaagtcagcagcgccgttttaaaacgtcccattgccgagtcatcaaaaccaaacagatccgccagatagtcaaacagccccagcgtcacgccaaggaaggaactggcgaccgcaaagttagagaacaccaccagcagcagatccaggctgcggctgttcagcacgccgctcaacgcctgtaccagcacatcaatattgccgcctttctgcgcaatgccgataaattccggacgtgggatgttgcccatcgtccccagcagccagacggaatagagcgccagcgccagtaacgtcccataaatcaggcatttcacgatggtgcgcggatctttgccgtaatatttcatcaggctcggtacgttaccgtgataaccaaaagaggccagacaaaatggcagcgtcatcagcaggtacggcgtatatgacgcgtggctttcagccacgttaaacaacgtggtcggctgaacgtgccctaacaggctgccgaaggtcaggaagaaagtaatcactttcgcgcccagcacaatcgccgtcatccggctgaccgccttcgtactcagccacacgacaaacgccaccagcagcgcaaaggcaaaacctgccgctcgcgccggaacgttcagcgacatctcagcaaaggtatgatgcagaattgagccgctcgccgagatataggcgtaagtcaggatgtagagcacaaaggcaatagagatgccatttaccacgttccagcctttccccaacagatctttggtgatggtgtcgaaactcgaaccaatgcggtagttaaggttagcttcgaggatcatcagcccggagtgcagcatacaaaaccaggtaaagaccagcgccgccatcgaccagaagaaccacgccccggacatgaccaccggcagggagaacatccccgcgccaatgatggtgccgccgataatcaccacgccgccaagcagcgaaggtgacgtttgggtggtggtaagtgttgccattcagctctctctccagtcatttatagtgtgactatctctcaatacgttgcactgtaccagtacacgagtacaaaagaaataaaaaaagccccgattgtgacgatcggggctgtatattttactttacgctgtgaatgcgcaggtcagcgtgagttacgcatcaccgccgaaacgacggcgaccggtagagtcatcacgacgcggaccacggctttcacgacgttcgccgctgaagcgacgaccatcaccacgaccaccttcacgacgttcgccgctgaaattacgaccgccttcacgacgttcgccactgaagctacgaccaccgccgcgacgttcgccgcccgcgtgcggaaccgcatcacccaacagctgcatattcatcggcttgttcagaatgcgagtacgcgtgaagtgctggagcacttcgcccgacatacctttcggcagctcgatggtggagtgagacgcgaacagcttaatgttaccaatgtaacggctgctaatgtcgccttcgttagcgatagcgcccacgatatgacgaacttcaacgccgtcatcacggcccacttcaatgcggtataactgcatatcgccaacgtcacgacgttcacgacgcggacgttcttcacgatcgccacgcgggccacggtcattacgatcgcgcggaccacggtcgtcacggtcacggaattcacgcttaggacgcatcggcgcatccggcggcagaatcagcggacgctcgccctgcgccattttcagcagtgcggcggccagcgtttcgagatccagctcttcaccttcggcagacggctggattttcgccagcagcgcacgatactgatccagatcgctgctttccagttgctgctgaactttcgcggcgaatttttccagacgacgtttacccagcagttctgcgttcggcagttccacttctggaatggtcagcttcatggtgcgttcgatgttgcgcagcagacgacgctcgcggttctcaacgaacagcagcgcgcgaccggcgcgacccgcacgaccggtacgaccgatacggtgaacgtaggactcggagtccatcggaatatcgtagttcaccaccaggctgatacgttcaacgtccagaccacgtgccgcaacatcggtggcgatcaggatgtccagacgaccatctttcaggcgttccagagtctgctcacgcagcgcctggttcatatcgccattcaacgcggcgctgttgtagccgttacgttccagcgcttctgctacttccagggtcgcgtttttggtacgtacgaagataatcgccgcatcaaagtcttccgcttccaggaaacgcaccagtgcttcgtttttacgcataccccagacagtccagtagctctggctgatgtcaggacgggtagtcacgctggactgaatgcgcacttcctgcggctctttcataaagcggcgggtaatgcgacgaatcgcttccggcatggtggcggagaacagagcggtttgatgaccttccgggatctgcgccataatagtttcaacgtcttcgatgaagcccatacgcagcatttcgtcggcttcatccagcaccagaccactcagtttagagaggtcgagggtgccgcgttttaagtgatcaagcagacgtcccggcgtaccgacaacgatctgcggcccctgacgcagggcgcgtaactgcacgtcataacgctgaccgccgtacagggcaaccacgtttacgccgcgcatgtgtttagagaaatccgtcatggcttcggcaacctgtaccgccagttcgcgggttgacgccagcaccagaatctgaggtgccttcagctcaggatcaagattgttgagcagcggtaaagagaacgctgcggttttgccgctaccggtctgggccatgcccagcacgtcgcgaccgcccagcagatgcggaatgcactctgcctggattggagatggtttttcgtaacccagatcggtaagggcttcaaggataggagccttcagccccagatctgcaaaagtggtttcgaattcagccatgtagtacgtgtgcctcaaaattaatggcggccagtctacataactcatcatgaaattgatctgcaattttcattgaaaagtgtgaaccggctcaaagtaggtgtattaacgaacaacaacgccctcacccgcgaaggtgatggcaatcaaaaagattacgggctgatatgttcgtcagctattgctggtccgattctgccaggtcatcttggtcctggcccaggagcgataattccaacaatgcgtatcggtgctcaacaaagttatgaacgttgttggccaccgccagtttgaacagagccgtggcgctgtccaaatcccccagacttaggtaatacttacctaaatagaagttggtttcactgagatgctcagcgagcgaggtgttatccgttgcgtccgccttgagcctttccatcagcgttgcttcgctaatgtcgcccaggtagaactcgacaatgttccatccccattgctctttatccgatttttcgaagcgtgcttttaacgcttctttcgcctgcttctcattaagcttctgctcaacaagatacagccacaggctgcggtaaggatcattgggatcgtcttgataaaacgccagcagatcatcttgcgctaacttatcacggccgccgtaatacaatgcgataccgcggtttaagtgcgcgtagttgtaagttggatcaagctctagtacagaatcaaacgcttcataggcagcatcaaaattgcctgcctgcgttaaataaatgcctaagtaattgaatacttcaggcatatccggtctgattgccagcgcttgtgaaaaatcatttcgcgctaatgccctcaaaccaagactatcatacaacactccgcgctcatataaaagctgtgcgcgttcgtcatcggttaaagcccgactggcaagaatctgttccatacgcgccagaatcacttcctgctgtaaagtcggttgcaatggtactgcgaggacttcacttttacgccaggcggaattactgcatcctgcaagcgtaagtgctgtcgcaacgaaacaccagcgcaaaaaaggcttcatttcccactcccgaagacaacgattgaatgaacgtcctgttccccggtggctcaacaaggcgtccagccaggtctaaagccccccgcactgcggagggcaaaaggctaccttactcggcctgttcgctcgccggagcttccggcgcagccgcaggttgagactgctcggttgcttctttaatgctcagacgtacacggccctggcggtcaacttccagaaccttaaccgggacttcctgacccatctgcagataatcggtcactttctctacacgcttatccgcgatttgagagatgtgaaccagaccttctttaccgccgccgatggcaacaaacgcgccaaagtcaacgatacgggtcactttactattgtagatacggccgacttcgatctctgcggtgatctcttcgatacgacggatagcgtatttcgctttttcaccgtcggtcgccgcgatcttcacagtaccgtcatcttcaatttcgatggtggtgccggtctcttcagtcagcgcgcggatcacagaaccgcctttaccgatcacgtctttgatcttgtccgtgctgatcttgatggtatggatacgcggcgcaaattcagagatatcgccgcgcggcgcgttgatcgcctgttccatcacgcccaggatgtgcagacgcgcacctttagcctggttcaacgcaacctgcatgatctctttggtgataccttcaattttgatatccatctgcagcgcagagataccgtcgcgggaacccgccactttgaagtccatatcgcccaggtgatcttcgtcgcccagaatgtcagacagtacaacgtagttgtcgccttctttcaccagacccatagcgatacctgctacggcggctttaattggcacgccagcgtccatcagcgccagagaagcgccgcacacggaagccatagaagaagaaccgttggattcggtgatttcagacaccacgcgaacggtgtacggaaatttatccatgtccggcatcactgccagcacgccgcgcttcgccagacgaccgtgaccaatttcacgacgcttcggagaaccgaccatgccggtttcgcctacggagtacggagggaagttgtagtggaacaggaagctgtcagtgcgctcgcccatcagttcatcaagcacctgcgcgtcacgggcagtacccagagtcgcggtaaccagcgcctgcgtttcaccacgggtaaacagagcggaaccgtgagttcgcggcagtacgccagtgcgcacgtccagaccacggatcatgtctttttcacggccatcaatacgcggctcgcctgccagtacgcggctacgtaccacgtttttctcgatggcgtgcaggatttcacccagctcgttagcatccagagtttcatcttctgcaataagctgctcgatggtttcggatttgattacgtcaacctgagcatagcgctcttgtttatcggtgatgcggtacgcgtcgctcagacgagattcagccagcgcagcaacacgcgcgttcaacgcgtcgttgacggcttccggctgccagtcccaacgcggtttaccggcttctttcaccagatcgttgatcgcctggataacaacctgctgctgctcgtgaccgaataccaccgcgcccagcatagtgtcttcgctcagcagttcagcttcggattccaccatcagcacagccgcttcggtaccggcaaccaccaggtccagcttgctttctttcagctcgtcctgggtcgggttcagtacgtactggtcattgatgtaacctacgcgcgccgcgccgattgggccgttgaacggaatgccggacagcgacagcgcagcggatgcgccgatcatcgccacgatatccgggttaacctgcgggttaacggaaacgacggtcgcaataacctgcacttcgttaacgaaaccttccgggaacagcggacgaaccgggcggtcaatcagacgcgcgatcagggtttcgccttcgcttggacggccttcacgacggaagaagctgcccgggatacgaccagcagcgtaggtacgctcctgatagttaacggtcagtgggaagaagtcctggcctggcttggcttttttctggccgacaacggtaacgaatacggcggtgtcatccatgcttaccataacagcggcagtggcctgacgcgccatcatgccagtttccagcgtaacggtatgctggccgtactggaattcacgaacgatcggattaagcaaaataatatcctttccaatttttgacggcacaatacgcgccgtcgttaatacccgatcttctgcgcatcctcgcgactaatgacaaccctaaccctgatatgggtaaagcctctcattagccgcgcgaacctctgcaacggaagatcattcatagcaacaatacattagtttccagcgaattgctgccatctgctggaaaaaaggggccatgaaggccccctctttctgaaactcgaaagaattagcgacgcagacccagacgctcaatcagcgcggtgtagcgtgcaacatctttacgtttcaggtagtcgagcagtttacgacgctgagaaaccatacgcagcagaccacgacggctgtggtgatcttttttatgctctgcaaagtgaccctgcaggtggttaatctgtgcagtcaacagagcaacctgaacatcggtagaaccggtgtcgtttgcgtcacgaccgaactcagaaacgattttagctgtagcttcagtacttagagacattttaaaactccaaagtatttaagaatgagaggacgccgatctctaattcagcgatcccagtgtacgccgcgtaaactgttaaataatttacgcgacgttaagcggcggtattctactcgcagcgctctcttatcgcaagacgaagcgacattacgccgggtactctactaccagccgacgaggcgcgacacggccttcgtcgtcaatttcgcccataccgataaatttatcgtcttcaccttccgtcacacgaaccagtcccttcaacggcgcgcccgtggtacgaaccgggttgccatttttgaagtataccgaagatgttaacggcagattaacaacaggatagtccgaagccggactatccattggcatcaataatggatcgagcaactgcgccgccggaacgccctgctgttccgcctgtgctaccagcgtctgcaagtgctccagcgtcaccatacgatccaccggatacttgctgaccgtcagacgacgcaggtacgttacgtgcgcgccacagcccagtttctcacctaaatcatcaataatagtgcgaatataggtgcctttggagcaatgaacttccagctccagctcgttaccttcatggcgaataaacagcagctcatagacggtaatcgggcgggcttcgcgcggcacttcgataccctggcgggcatattcgtacagcttcctgccctgatacttcagcgccgaatacatcgagggaatctgttcgatatccccacgaaaggtctccagcgcgctcgcaagctgctcagcgctgaaagtcaccggacgctcctgcacgatttgaccatcggcgtcagaggtatctgtgcgctgccccagacgggcaataacacgatagcgtttgtcagaatccagcaagtactgcgaaaattttgtcgcttcgccgaggcaaatcggcaacatgccggtcgccagcgggtccaacgcgccggtatgcccggcgcggttggcattgtagatgcgcttaactttctgcagcacgtcattgctggacataccctgcggcttatccagcaacagaacgccgtgaatgtcgcggccacgacgacgaggacgactcatcagtcctccttgctgtcgtccgggttcacacgacgttcttcgtcatgtttcaccacgttagtcaccaggttggacatacgcatcccttccaccagcgagttatcgtagaagaaggttagttccggcacgatgcgcagacgcatcgctttacccagcaagctgcggatgaaaccagacgcttcctgcagggccttaatgccgtttttcacagccgcttcgtcctgatcgttgaggaacgtcacgaatactttggcgtatgccagatcgcgggacatttcaacacccgatacggtggtcatcatacctacacgtggatctttgatttcgcgttgcaggatgagcgcgatctctttctgcatctcttgcgctacgcgctgcgggcgaccaaattctttcgccataataaattctccagaataaagacaaaaaaggggccataagcccctttttaaatttcttgccgggtggcgcttcgcttacccggcctacgcctaatcatcttctaaggattttggattgcaacaaggcggcaagctcgtaaatccccgggagcatagataacgatgtgaccggggtgagcgagcgcagccaacgccgttgcggcccaaaagacgacgaagattaagcgatggtacgttggatctcgataatctcgaacacttcaatcatatcgccaacgcgaacgtcgttgtagttcttcacgccgataccacattccatgccgttacggacttcgttaacgtcatctttgaagcggcgcagggattccagctcgccttcatagataaccacgttgtcgcgcagtacgcggattggattatggcgtttaattgtaccttcggtaaccatacagcccgcgatcgcgccgaatttcggcgatttgaacacatcgcgcacttcagccagaccgatgatctgctgtttcagttccggagacagcatgccgctcatcgccgctttcacttcgtcgatcaagttatagatgacggagtagtaacgcagatccagactttcggattcaatcactttacgcgcagaagcatcagcacgaacgttgaagcccaccagaatcgcgttggacgccgcagccagggtcgcgtcggtttcggtgataccacctacgccagaaccgatgatcttcactttcacttcgtcggtagacagtttcagcaaggagtcggagatcgcttccacggaaccctgtacgtcagccttcagcacgatgttcacttcgtgaacttcgccttcggtcatgttgacgaacatgttctcgagtttagatttctgctgacgagccagtttaacttcacggaatttaccctgacgatacagagcaacttcacgcgctttcttctcgtcgcgaaccacggtcacttcgtcaccggcagccggaacgccggacaggccgaggatttccaccggaatggacggacccacttccagcacttcctgacccagttcgttacgcatcgcacgcacgcggccgtattcgaagccacacagcacgatatcgcccttatgcagcgtaccttcgcgtaccagaacggtagccaccggaccacgacctttatccaggaaggattcgatcaccgcgccgctcgccatacctttacgaaccgctttcagttccagaacttcggcctgcagcaggatagcgtcaagcagttcgtcgataccggtgcccgctttcgcagacacgtgaacgaactggctctcgccgccccactcttccggcagaatgccgtactgggacagttcgttcttcacacgatccggatccgcttccggcttatcgattttgttcaccgcaaccacgaccggcacacctgccgctttcgcgtgctggatagcttcgatagtctgcggcatcacgccgtcgtctgctgcaacaaccagaaccacgatatccgttgcctgagcaccacgagcacgcatggaggtaaacgcggcgtggcccggggtgtccaggaaggtgatcatcccgttgtcagtttcaacgtggtaagcaccgatgtgctgggtaatgccacccgcttcgccagaggccactttcgtggaacgaatgtagtccagcagagaggttttaccgtggtcaacgtggcccatgatggtcacaaccggtgcgcgcggttcagccgcagcgccggtatcacggtcgctcattaccgcttcttccagttcgttttcacgacgcaggataactttgtggcccatctcttcggcaaccagctgtgcggtttcctggtcgatgacctggttgatggtggccatggcgcccagcttcatcatcgctttgatgacctgagaacctttcaccgccatcttgttcgccagttcgccgacggtgatggtttcaccgatcaccacgtcacggttaacggcctgagcgggcttctggaagccttgctgtaaagaagaccctttacgcttgccgcctttaccgccgcgaaccgcagcacgcgcttcttcgcgatcggctttggattcggcatgtttgccttttttcgccggacgcgccgcttttgcattacgaccacgaccacgaccaccttctacttcacgatcgttttcgtcttcggcctggcgcgcgtgctgagaagtggtgacatgatagtcactggtgtcttctactggctcaggcgttgcggtccatttgttttcttccgccatgcggcgagcttcttctgctacacgacgcgcttcttcttcgagtttgcgacgtgcttcttcttccgctttacgcttcagctctgcagcttcattctcacggcgggctttttcggcctgggcggttttggtcatatcgtcagtctgttgattgctcactttgtctttttccgcagcttcacgtttcgctttttcagcggcttcacgcttagcttgttctgcggcctcgcgttcagctttttgttgcgcctcgcgtttggcctgttcttctgcctcacgacgggcttgctcttccgcttcacgctgcgcctgctcttccgcggccaggcgttcagcctcttgcggatcgcgtttcacaaaggtgcgcttcttgcggacttcgatttgtaccgatttactttttccaccggtaccaggaatattcagggtgctgcgcgttttacgctgcagcgtcaatttatcggggccagaaaccgcttcgcggttcaggtgcgccagtaaagtctgtttttcttgtgcggacacagagtcgtcagcagatttccggatacctgcatcagcaaactgctgtaccaggcgatccacggaaacctgtctctctgcggccagcgcttttagggttaaatctgtcatgctgttccttcctgctacagtttattacgcttcgtcgccgaaccagcaaatattacgggcagccataatcagctcaccggctttttcgtcggtcaacccttcgatatcagccagatcatcaatgccctggtcggcgagatcttccagcgtacaaacaccacgagccgccagtttgaaagccatatcgcgatctaatccttccagattcagcagatcgtcagccggtttgttatcacctaggcttgcttcctggtcctgcgccagagtggccagtgcgtttttagcacgctcgcgcagtgcttcaacggtcggctcatcaaggccgtcaatttccagcagttctttcattggcacataggccagttcttcgagcgtggagaaaccttcttctaccagaacggtcgcgaactcttcatcaatatcaagatatttagtaaagatctcgatagcggcatgtgcttcagcctgatgtttagcctgcaagtcatcaacggtcattacgttgagttcccagccgctcaattgcgaagccaagtggacgttctgaccattacgtccgatcgcctgcgccagattaccggcttcaacggcgatatccatggtatgtttatcttcgtccaccacgatagacgcgacatctgccggcgccatcgcattaatgacgaactgcgccgggttatcatcccacagcacgatatcgatacgctcaccgcccagttcggtagagaccgcctgaacgcgcgcgccgcgcatccccacgcaagcgccgaccggatcgatacacttatcgttggttttcactgcgattttcgcacgagaacccggatcgcgagccgccgctttaatttcaatcacttcttcgccgatttccggcacttcgatgcggaacagctcgatcagcatttccggcttggaacgggtgacgaacagctgcgcgccacgcgcttccgggcgaacagcatacagcacgccgcgaatacggtcgccagggcggaagttttcgcgcggcagcatatcttcacgcagaatcaccgcttcagcgttaccggccatcccttcggatttaatttccaaagagatattgtcgcggttcactttcttcaccacgccagtgacgatttcgccttcctggtcgcggaactgatcgacaaccatcgcgcgttcagcttcacggactttctgcacgataacctgtttcgcagtctgcgtggtgatacggtcaaaggtgacagattcaatctgatcttcaacatagtcgccgacattcaggctttcgtcttcaaagcgcgccgcttccagcgtaatttccttcgtcggcatggtcacttcttcaacgatcaaccaacggcggaaagtatcaaaatcaccgcttttacgatcgatttctacacgaacatcgatctcctgctcatattttttctttgttgctgtcgccagcgcactttccagcgcttcaaaaattttttcgcgtggcagcgctttttcgttggagacggcttcaacaacagccaaaatttctttgttcatcgcgggcttttcacctcatccagactgttaaaagtggggaaccaggttcgccttctggatattactcagcgcgaacacttcatctttgccttcgactgtgacggtaatcatttcaccgtccaccgctttgataatgccctgccacttgcgacggttctgtaccgccatgcgaagaaccagcgcgacctcttcaccctggaaacgcgcataatgatcggcagtgaacataggacggtcgagacccggtgacgagacttcaaggttgtaagccacggagataggatcttcaacgtccagcaccgcgcttacctggtggctcacatcagcacaatcatcaacattgatgccatcttcactatcaatatagatgcgcagtgtggatgtgcgaccgcgaataaattcgatgccgaccagctcgtagcctaaggcttcaactggcgctgtaatcatctctgttaatttttgctctaatgtggacaagcccacccccaagacataaaaaaagggcctaaagcccagttattctgtagtcagataacaaaaaaccccgataaatcggggctttagataactgaaccctataaccgcaacggcggtctggtgtaccttccgaaagaatttttttcaaatccagctacgaaggacataatcttcacagtatatttgaaaaagaactctaagggaaagtggttgcgggggccggatttgaaccgacgaccttcgggttatgagcccgacgagctaccaggctgctccaccccgcgcctgaaacgtggcaaattctactcgttttgggcaaaatttgcaaatactgctgggatttggtaccgaggacgggacgtaaaatctgcgcacagtatagtgaccaggcatgagttatgtcaaccctattcccaatatgcagatgaatgaatatcactcttcgttatactcatcccacctctcctgcttatacacgcatttcacaacgttatttcagtaaaccttcactaaatgcttcctgtctctgctaaaagatgattaaatgaaaactcatttattttgcataaaaatgcactaaagcagaaaccgatctcattatcagtcaatcaagcagggttctattctatgacgacgattcttaagcatcttccagcaggtcaacgtattggtatcgctttttccggcggtctggacactagcgccgcgctgctgtggatgcgacaaaaaggagctgtcccatatgcctatactgcgaatctgggacaaccggatgaggatgactatgacgccattcctcgtcgcgcaatggagtatggcgcagagaatgcccgcctgattgattgccgcaagcagttggttgcagaagggatcgcaacgattcagtgcggcgctttccataatacgactggcggactgacctatttcaataccacgccgctgggccgtgccgtgaccggcacgatgctggtcgccgcaatgaaagaagacggcgtgaatatctggggcgacggcagcacctataaaggcaacgatattgaacgtttctatcgttacggcctgctgaccaacgccgagctgcagatttacaaaccgtggctggataccgactttatcgatgagctgggcggccgtcatgagatgtctgaatttatgattgcctgcggtttcgactataagatgtcagtcgaaaaagcctactccaccgactccaacatgctcggcgcgacgcacgaagcgaaagatctggagtttcttaactccagcgtcaagatcgtcaacccgattatgggcgtgaagttctgggacgaaagcgtgaagatcccggcagaagaggtgaccgtccgtttcgaacagggacatccagtggcgctgaacggtaaaaccttcagcgatgatgttgagatgatgctggaagcgaaccgcatcggcggacgtcacggcctgggcatgagcgaccagatcgaaaaccgtatcattgaagcgaaaagccgcggtatttatgaagcccccggaatggcactgctgcacatcgcttacgagcgtctgttgaccggtattcacaacgaagacaccattgaacagtatcattctcatggtcgtcagttgggtaaactgctgtatcagggtcgctggttcgactctcaggcgctgatgctgcgtgacggcctgcaacgttgggtcgccagccagattaccggtgaagtgacgttggagctgcgtcgcggcaacgactactccatcctgaacaccgtgtcagacaacctgacctataaggctgagcgtctgaccatggagaaaggcgagtccgtgttctcgccagacgatcgtatcggtcagttgaccatgcgtaatctggacattactgatacccgcgagaaactgttcggctacgcgaaagcgggtctgttaaccgcctcttccgcgaccggtctgccgcaggttgagaatctggaaaacaaagcgaagtaaacatttatcattctaaggccgcgaaagcggccttttttatgcgcggaatataaggtgtctataggcctgataaacgtagcgtcatcaggcgttgtaataatgtcggatggcggcgtaaacgccttatccgacctacagaaaatcacaaataacagacgaaaaaaaagacgcttttcagcgtctttctttcggaatattggtaccgaggacgggacttgaacccgtaagccctattaggcactaccacctcaaggtagcgtgtctaccaattccaccacctcggcacggatactgctattagcgcgggatatcgctggtcggctgggccggtgcagcaggttgagtctgctcggttttcgccggcgcgctcagattttcccactcgcttcctttattggttttgttgctattgatattacccaacaccagactgatgatgaagaacagcgtcgccaataccgccgtcattcgagtcatgaagttaccagaaccacttgaaccaaatagcgtagcggaagcgcctgctccgaaggaggctcccatatcagcgcctttaccttgctgcagcatgatcagacctacaaggccaattgccacaataaggaaaacaactaaaagagcttcgtacataatcaacctgttccttgcggagttgccgcgtaccaatgcttctaccaataaagcgggatttttactgtttcccactgaagcgggtgtgaatactaaccaaagcgaatgaccttcgcaagggcaatttaagcgcattgtatcaactgcggaaaaaaacagcaaaagcgttgttttttgcgggcagtaaggcggcaaccgccgcctttttagtcacttaaacgcttaaacggcttttaccgcatccgcgatacgatgggcgaaagccgtaacctgcgcttcatcctcgccttcaaccatcacgcgaatcagcggttcggtaccggatttacgtagcagtacccgcccacgattgccgagcgtggcttctacgtccgccgttaccgctttcaccgcttcattttccagcggatcgccgctaccagcggtgtaacgcacgttaaccagaatctgcgggaacattttcattccgctgcacagatcgtgcagactcatatgattacgcaccatcgccgccagaacttgtagccccgccacaataccgtcgccagtggtcgttttatccagcagaataacgtgaccagagttttccgcgccgatgcgccagcctttttcctgcaatttttccagcacatagcggtcgcccactttcgcccgggcaaacggaatgccaagctgcttgagcgccagctccagccccatattgctcatcagcgtccccaccgcgccgccgcgcagttgcccctggcgcagcccttcgcgcgcgatgatatacatgatctgatcgccatcgactttattgccttcatggtcaaccatgatgacccggtcgccgtcgccgtcaagcgcgatgccgaggtccgccttctccgccaacacgcgcgcctgcaacgcgcgcacgtcggtcgcgcccacttcttcattaatgttgacgccgtttggctcacagccgatggcgatcacggtcgcgcccagctcgcgcagcacattcggagcgatgtggtaggtagcgccgttggcgcaatccacaaccactttcaggccgttgaggctcagttcgttcgggaaggtgcctttacagaactcaatatagcgtccggcggcgtcgacgatgcggctggctttccccagctcggcggagtctacgcaggtgatctctttttccatttcggcttcgatggcttcttccacatcgtcaggcagtttcgtaccgtcgatagagaagaatttaatgccgttatcatagaacgggttatgggaagccgagataacgatacccgcctccgcgcggaaagtccgcgtcagataggcgacggctggcgttggcataggtccggtaaacgaggccgacagccccgcagcggcaaggcctgcctccagcgcggattccagcatatagccggaaatacgcgtatctttaccgataatgattttacgcgaaccatgacgcgccagcacttttccggcagcccaacccagtttaagcacgaaatcaggtgtaatgggggcattgcctacacgtccgcgaatcccatcggtaccgaaatatttacgattactcatagcgtttgtttccctttgcagacagagtggcttccaccacccgcatcgcctctacggtttctttgacgtcatggacgcgaatgatctgcgcgccctgcatcgcagcaattaccgcgcacgcaaggctaccgttcagacggtctgatggtcccacgttaagtaactgaccaaccatcgttttacgtgacatgcccaccagcagcggcaggttaaaatgatgaaactcacccagtcgcgccagtaaggtataattgtgagagagatttttaccgaaaccgaatcctgggtcgagcaacaatttctcttttgcgatgccggccttctcacaacgtgctatttgctcaataaagtagcgattcacctcggcaaagacatcgtcatatttcggcgcctcctgcatggttttggggttgccctgcatgtgcataagactgaccggcaagccggtttccgctgccgcttccaacgcgccgggttcggagagtgaacggacatcattgataatatgcgcgcccgcccttgccgcttcacggatcacctcgggtttagaggtatccacagaaatccacacttcaaaacgttgcgcgattgcttccagtaccggaataacgcgatccagctcttcttccacgctcacttctgccgcgcctggtcgcgttgattccccccccacatcaataattgtcgccccggtattcaccattaaattcgcatgtttcaccgcctcaatcagcgtgttatgcgcgccgccgtcggagaacgaatccggcgttacgttcaggatccccataacatgcggatgagtgagatcgagcgtggcgccctgagcgaagagtttcatggtcaaaatccctgttttatttatggtgagttaaaaaaagaaaaaccccggggcaagccccagggtttcggtgagcgctaaacataatgttgtaaaacaaatgcttatttgtcgcccagctgctctgacatcgtgttgcccgggttcggcgtgcgtggttcatcaaccggacgcggcgcctgaggcgtaccattgctgtcagagttattggtgccgtttggatcttcccagcccgcaggcggacgcacttcacgacgcgccatcaggtcatcaatctgcggcgcatcgatggtttcatatttcatcagcgcatctttcatcgcgtgcagaatatccatattgtcagtcaggatctgacgagcgcgattgtagttacgttcaatcagcgctttcacttcctggtcgatgatacgcgcagtttcatcagacatatgtttcgcttttgcgacgctacggccgaggaacacttcgccctcttcttccgcgtacagcaacggaccgagtttctccgagaagccccactgggtgaccatgttacgcgccaggttagtcgcgactttaatgtcgttcgacgcgccggtagaaacatgctcaacgccgtagataatctcttccgccagacggccgccgtacagcgtgctgatttggctttccagcttctgacggctggcgctgatcgcgtcgccttcaggcaagaagaaggtcacgcccagcgcacgaccacgcgggataatcgtcactttgtgcaccggatcgtgttccggcaccaggcgaccgataatcgcgtggcccgcttcgtggtacgcggtcgactctttctgcgcttccgtcatcaccatggagcgacgttcggcgcccatcatgattttgtctttcgctttctcgaactcaaccatcgacactacgcgcttgttgccgcgtgcggcaaacagcgccgcttcgttgaccaggttcgccaggtccgcaccggagaagcccggcgtaccgcgcgcaatgatcgccgcatcaatgtccgtcgctaacggtacgcgacgcatatgcaccttcagaatctgctcacgaccgcgaacatccggcaggcctaccaccacctgacggtcaaaacggccaggacgcagcagcgccgggtcaaggacgtccggacggttagttgcggcgataacgatgataccttcgttaccttcgaagccgtccatctcaaccagcatctggttcaacgtctgctcacgttcatcgtgaccaccgcccagaccagcgccacgctggcgacctacggcgtcgatttcatcgatgaagataatgcacggtgccgctttcttggcttgttcgaacatgtcacgcacacgagatgcgccgacacccacgaacatttccacaaagtcagaaccggaaatcgtaaagaatggcaccttcgcttcacccgcaatggcttttgccagcagggttttaccggtacccggcgggccgaccatcaggacgcctttcggaattttaccgcccagcttctggaaacggctcggttcacgcaggtattcaaccagttccgccacttcttctttcgcttcgtcacaacccgcaacgtcagcaaacgtggttttgatctgatcttccgtcagcatacacgccttgctcttaccgaacgacatggcgcctttgccaccgccgccctgcatctgacgcatgaagaagatccagacgccgatcagcaacagcatcgggaaccaggagatgaagatagaagccagcaggcttggctcttcaggtggttcgccaacaaccttgacgtttttagtcagcaggttatcaagcagcttcggatcattaatcggaatgtaagtcgtgtaacggttactatctttcttggtaacgttgatctcacgtccgttgatacgcgcttcgcgaacctggtcctgattgacctcttgcaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagtttctttcaaaccttacgtctgaaatctgccggttatcactttcgcccggtcgctacaatgtacacttcacgcgaacgcgcgcgcgaagagtccggcttacgaactttaaccttcgtaaacagggagcgaatttcccttagatactcatcgaaaccttcgccctggaacaccttcactacaaaacttccgcctggcgccagcacatcgcggcacatatctaacgccagctccaccagatacatggcgcgggggatatccaccgccggtgttccgctcatgtttggtgccatatccgacatgacaacttgtactttactgtcacccacgcgttccagtaacgctttcatgacaagttcatcacgaaaatcgccctgaagaaagtccacaccaacgataggatccataggtaaaagatcacaagcgatgatgcggcctttgccgccaatctgcgtgaccacatactgtgaccaccctcctggcgcagcgccgagatcgactaccgtcattcccggcttaaaaagtttgtcactttgctgtatttcatcaagtttaaaccaggcacgggagcgtagcccctttttctgcgcctgttgaacatatttatcgctaaagtgttcctgaagccagcggcttgagctggcagaacgctttttacctgtcatttaactttcccgtcggggcagttcatcgtagccaatggcgtaaatttctacacgcctatttggcgatataagggagatggcggtagaatgacccgttttcaatcccaacgtaagcaaaaatatacgatgaatctgagtactaaacaaaaacagcacctaaaaggtctggcacatccgctcaagcctgttgttatgcttggcaataatggtttgaccgaaggggtactggccgagattgaacaagcgttagagcaccatgaacttatcaaggtgaaaatcgcctcggaagatcgcgaaacaaaaaccttgatcgtggacgctatcgtgcgcgaaaccggcgcctgtaacgtacaggtcatcggtaaaacgctggtgctgtatcgcccaactaaagagcgtaaaatctcgctgccgcgttaaggatatcctaaagtcgaacacaaaatctgtgtaaaacgaggggttttccacgagcaggagagcaaaatgccacgctctctccgttgataaaaggccgctatgcggcctttttcctttctttacaatacaccaacaatttgcgtattgagtactgcttaaaggtattccactttaagcacttcgtattccacatcgccgccaggcgttttgatcaccacgacgtcatcctgctctttgccaatcaggccgcgagcgattggcgagtttaccgaaatgagattttgcttaaaatccgcctcatcatcgccaacaatacgataggtctgctcttcgtcggtgtccaggttcagcaccgtgacggtagcgccgaaaatcacgcgaccattgttcggcattttggtgacgtcaatcacctgcgcattcgacagttttgcttcgatatctttaatgcgcccttcgcagaaaccctgctgttcgcgtgcagcatgatactccgcgttttcttttaaatcgccatgttcgcgcgcttcggcgatagcggcgatgatttcaggacggcgcacagatttcagaaaatccagctcttcgcgcagtttttcggctccgcgtaaggtcatcggaatagcttgcatttgttatacctcttgaacattcctgtagggggcaatgaactctaccccggctgctaagccagccccggcatatgccataccagggtcagaagcaaaaaaacaccaacccgggcgcgcagtcccaggtcagctacaatttcctctttgataaccattttaccctggagttccctatgggtcatcgtttactttttagggcgttgcgccgtagtatgacggcttgtttccagggtgttagcgcgagattatgcgattttccagatttatcatcggattgaccaccagtatagcgttcagcgttcaggccgcgaatattgacgaatacatcaaacagcttccggccggcgccaacctcgcgctgatggtgcaaaagattggcgcgcccgcgccggctattgattatcatagtcagcagatggcgcttcccgccagtacccaaaaggtgattaccgcgctggcggcgctgattcaactcggcccggatttccgttttacgaccacgctggagactaaaggcaacgtcgataacggcatcctgaaaggtgacttaattgcgcgattcggtggcgatccaacgctaagacgtcaggatattcgcaatatggtcgcgacgctgaaaaagtcaggcgtcacgcaaatcgacggcaatgtgcttatcgacacgtcgattttcgccagccacgataaagcgccaggctggccgtggaacgacctgacgcagtgtttcagcgcgcctcccgccgccgccattgttgaccgcaactgtttttctgtgtcgctttatagcgcgcaaaaaccaaacgatttagcttttattcgcgtggcctcttattatccggtaacgatgttcagccaggtacggactctgccgcgcggttcggcagacgcgcagtattgcgagctggatgttgtgcctggcgatttgaaccgttatacgcttaccggctgtttaccacagcgcgccgacccgctgccgctggcctttgctattcaggacggcgccagctacgcgggcgcgatcctcaagcaggaactgaaagaggccgggataacttaccgcggcacgctgctgcgccagacgcaggttaacgagcccggaacgatcgtcgccagtaaacagtcggcgccactgcacgatctgcttaagattatgctgaaaaagtcagacaacatgatcgccgatactgtttttcggatgattggtcatgtcaggtttaacgtgcctggcacctggcgggcgggatcggatgctgttcgccagatcctgcgccaacaggcgggaattgatatcggcaataccattattgccgacggttccggtctttctcgccataacctgatcgctcccgccacgatgatgcaggtgctgcaatatatcgcccaacacgataacgagctgaactttatctctatgctgccgctggcgggctatgacggttcattgcaataccgcgccggcctacatcaggcgggcgtagacggtaaggtttcggcgaaaaccgggtcactgcagggcgtgtacaacctggcgggctttattaccaccgcaagcgggcagcggatggcatttgtacagtatttgtccggctacgcggttccacctgccgatcagcgtaatcgacgtattccgctggtacgcttcgagagtcgattgtacaaggatatttatcagaataactgagtgcattattgccggatggcggcgctaacgcgtcttatccggcctacaaagaacataataaaacgggccgcaaatgcggcccgttggcttttgtaggccggataagcgtaagcgccatccggctacgagattaacgtttgtagatgaactcgacgccttcttcgtcgtcttcatcccagtcgtcatcccagtcatcgtctgcgtcttcttccacttcagccaactgctggcgatgataatcgtcccacatgaactcgactttttccggctgttttgcttcttcagcctgcgcgatcggattctcgatgataaaggtcatcacatcccagcagagatctttcacccctagctgactggcagcggaaatcagatagtatttcccttcccagcccaacgcttcggcgatcgctttcgctttctcttccgcttcggatttatccatcagatcgatcttgttgaacactaaccagcgcggtttagccgccagatcctggctgtatttttccagttcgccaataatgatacgggcgttttccaccggatcggaaccatcgatcggatcgatatcaatgaggtgcagcagtacgcggcaacgttcgaggtgcttcaagaagcgaatccccaggcccgcgccttccgccgcgccttcgatcaaccccggaatgtcggccaccacaaaactcttttcgctgtccatacgtaccacgcccaggctcggcaccagcgtggtaaacggatagtccgcgactttcggttttgctgccgataccgcgcgaatgaacgttgatttaccggcatttggcatccccagcatcccgacatccgccagcagcatcagttccagcagcaggtcgcgcttatcgcccggcgtaccattggttttctggcgcggcgtacggttaaccgaggatttaaaacgggtattgcctaacccatgccagccgcccttcgcgaccaacagacgctgaccgtgtttggtcatgtcgcccatcgtttcaccggttccttggtcgataacgcgcgtaccgaccggcactttgatggtcacgtctttaccgcgtttaccggtacagtcgcggctcgcgccattctgaccacgttcagcgcggaacgatttttcaaagcggtaatcgatcagcgtattcaggttttcatcggcttccatccagacgtcgccgccgtcgccgccatcaccgccgtccgggccgcctttcgggatatatttttcgcggcggaagctcacacagccattaccgccatcgcctgcaacgaccagaatcgatgcttcatcaacaaacttcattttattctccgtaaatcattcgcctgagcggggttgcgaaaccaccgtttcatgcttgcgtaaaccgccccaaatacgatgaccaatggcggaatacatcgcgcccgcaaccacgacaaacgcaccgagataacctaaaaggtttaacatcggtctggcgaagaaatcgggccaggccatagataaaagatctgaaaacagcagggtaaatagcggtgtaagcgtgattatcgcgctcacctgcgccgcctgccaacgcgccatcgcttccgccagggcgccatatcctaccagcgtatttagcccgcagaaaatcaaacaggcgagctgccagtcgctcagttgcgctatcaccatcggttttgccaacggcaaaagcgctatcgtacataaagtgtacagtaaaaacaggatctgctgcgaggccagacgtcgcaataatactttttgcgccacgccatagctcacccacaccatcgccgcgcctacgccaaaaataacgccccaggtgtagtcggtcagtcgggtaaaaatctcgatcagactggtgttaaaaaacattaccagcccgctcaataacatcagcgcgccaatcacctgcgtaccgcgcatcttttctttcagaataaagacgctggcgaccatcatgccaaccggcgagagctggccgataacctgcgacgcggttgggcttaaatattgcagggaagaactgaacaaaatgaaattaccgaacagtccgcaggtcgctatcgccaataacaccaaccagcgcggcttacgaaaaatacgcagcggcggcagctttctttttactgccagtatcgccccgaggccaatactggccattaagaagcggtagaagacaatggttgaaggctccatcacctccagcacttgcttcattgctattggcaacgctccccagcacatcgcggtagtgagcgctaaaagaatgccaatgcctgcctgctgcttcatgccgtgttccctgcaaagacccgttaacggcattcacacagccacacggatatattttagtcggccatcgaatgtaaaaagccccgcaacaggtgcggggctttcatccgttaccggaccacaaaaaacttactcagcaacgatgctgatgtatttacggtttttcgggcctttaacttcgaatttcactttaccgtctgctttagcaaacagagtgtggtcacgaccgcaaccaacgttggtgccagcgtggaatttagtaccacgttgacgaacgatgatgctgcctgccagaactgcttcaccgccaaagcgttttacgcccagacgtttagcttcagaatcgcgaccgttacgagtcgagccgccagcctttttatgtgccatttaatctgctcccctaatcttaagcgctgatgccggtaattttcacatcagtgaaccactgacgatggccctgctgcttacggtagtgtttacggcgacgaaacttaacgattttaactttctcgccacgaccgtgggcaacaacttcagctttgattacgccgccatcaacgaaaggaacgccgattttgacttcttcaccgtttgcgatcatcagaacttcagcgaactcgatagtttcgccagttgcgatgtccagcttttccaggcgaacggtctgaccttcgcttactcggtgttgtttaccaccactttggaaaaccgcgtacataaaaaactccgcttccgcgcacacctttcaatgattcagagcgcgctataaatattcacaatagggcgcgaatattacgcaaattgcacggctttgacaagtgctaccatcaatacatgaagaaaaaaaaacacaacgcatacggtaacgtttatctgcggcgttttttcagtacaatcagggtatatttctaaccataaaccctacgttacctcattcagacatgggataatcggagcgataagcccggcttttgcgatgaatttagaaaaaatcaacgagttaaccgcgcaagatatggcgggtgtcaatgcgacaatccttgaacagcttaattccgacgttcaactgattaatcagctaggatattacattattagcggcggcggaaaacgcattcgtccgatgattgccgttcttgccgcgcgtgcggtgggttatcagggtaacgcgcacgtgactatcgccgctctgatcgagtttatccacacggcgacgctgctacatgatgatgtggtggatgaatctgatatgcgtcgcggcaaagcgacggcaaatgccgctttcggtaatgccgccagcgtgttggtcggcgactttatctatacccgcgccttccagatgatgaccagcctcggctcgttaaaagtgctggaagtgatgtcggaagcggtcaatgtgattgcagaaggcgaagtgctgcaattgatgaacgtgaatgacccggacattaccgaagaaaattacatgcgggtgatttacagtaaaacggcccgtctgttcgaagccgccgcccagtgctccggtattcttgccggttgtacgcctgagcaagagaaagggttgcaggactatggccgctaccttggtacggctttccagctcattgacgatctgctggattacagtgccgacggcgagcatctcggtaaaaatgtgggtgatgacctcaatgagggcaaacctaccttaccgttgcttcacgccatgcgccacggtacgccagaacagtcagcgatgatccgtaccgctattgaacaaggtaatggccgtcatcttctggaaccggttctggaagcgatgaccacctgcggctcgctggaatggacgcgtcagcgagcggaagaagaagccgacaaagcgatatccgcgttgcagatattgccggataccccatggcgtgaggcgctaatcggtctcgcacacatcgcggtgcagcgcgatcgttgatgccattctcttatcccgcgcactgcgcgggatatcccattaagttctaataaactccagataccctattgcctgtcttttcgtatattcatatacggcttcccctggcatattctgaatattgccgccacttacatgaactttttagaacattccttcacgaagcgttatagtatcgaacgtcgtcgggttgttaaaaccgtaagtgattaatctaaggagtgatggatgtatggaaagcaagcttattgactggcatccggccgatatcattgccggactacgtaaaaaagggacttcaatggccgctgagtcacgccggaatggattgagttcatccacgctggccaatgcattaacgcgcccgtggccgaaaggagagttgattatcgcgaaagcattgggaacggaaccctgggttatttggccatcgcgttatcacgatccgcgcacgcatgagtttatcgacagaacgcggcttatgagagcgcgtaataaagacaaacagaatgtagagtaagtgcctgtaaaacaacccccgcaatcgcgttcgcgggggttattcagcgtacagaaggttattcgcctttcacgcgttcaatattcgcgcctagcgcgcgcagtttgtcttcgatgcgctcataaccgcgatcgatgtgataaatgcgatccacaatcgtcgtgccttccgcaatacagcccgccagcaccaggctcgcagatgcccgcagatctgtcgccatgacctgggcgccagagagcgtttctacgccatggcatatgacggtattgctttcaatttccgcacgcgcgcccatgcggctgagttcaggcacgtgcataaaacggttttcaaagacggtttcagtgataaagcccgtcccttccgccaccaggttcagcaacgtgaactgcgcctgcatatcggtcgggaatgccgggtgcggcgctgtacggacattgaccgctttcggtcgtttgccgtgcatgtccagactaatccagtcctcgcccacttcgatatccgcgccagcatcgcgcagtttcgccagtaccgcgtccagagtgtccggttgcgcgttacggcagaggattttgccgcgagagatcgctgccgccaccaggaaagtccccgtttcgatacgatccggcagcacacgataaacgccgccgcccagacgctctacgccctcgatcgtaatacgatcggtgccctgcccggcgatcttcgcccccagcgtaactaggaagttagcggtgtcgacaatttccggctcgcgcgcggcgttttcaatgatggtcgtcccttccgccagcgtagcggcgcacataatggtgacggtcgcgccgacgctgaccttatccatcacgatatgcgcccctttaagacgtccttcgacggaggcctttacgtagccctcttctagcttgatggtcgcacccagttgttccagaccggtaatatgtagatcaaccggacgcgcgccgatagtacagccccccggcagagagacttgtccctgaccaaaacgggcaaccagcggccccagcgcccatatcgaggcgcgcatggtcttaaccagatcataaggcgcgcagaacacgttcacctggctggcgtcaatgtgtaccgatccattgcgttccactttcgcgcctaattggctcaggagcttcatcgacgtatccacgtctttcagttttggaacgttttggatctctaccggttcttctgccagcagagcggcgaacaggatcggcagcgcggcgtttttggcgccggaaattgtgacttcgccctggagcgtcgttggcccctgtacacgaaatttatccattattgtattctcagttaagcattcatctccgctaccggcaggttacccgtagcttaaaatccgttaagtttacgatcgcgcgcccattccgccggggtatatgctttgatcgatacggcatggatacggttgtccgcaatgtactccattagcggcccatagaccgtttgctgtttcttgacccggctcatgccgtcaaacatctcgcccacggcaataacctgaaagtgactgccatcgccggagacgtggacttcctggagggagagggcattcatcagcacactctgaatttcatgattttccatgggttctttattcgtcaaatagtgaaaacagcccaacatcttagagcaaagtcgcgccgtcttaaataagcaaaagattacgctgataaatcagcgcggtaaaagtgccggatggtgctgctaacgcaatttatccggcctacggggatcatgcgaagtgtaggccggataaaccatccggcattcattacatacggggaagtacgtcttcaggcaagttatataattgcgccagcgcgtaaaccttgtcgttaacgccagacagcgacacggcattgccctgcttttttgcctggttcacaaggtgcgccagcagcgccagtccccccgtatctaccctggagatctggctcaggtcgatacgggtaacgccattcatcgcttctacgcgcgcgtcccatagcggcgccaacacgtcctgatccagctctcccgccagcaccagagtgtccgcctcacgcgtccaggtgagttgcggcgtcattactgtttctcgtccaaagtaattttctgttgagagatagatttcagttgtgcggtcaggccgtcgatgcctttagtacgcagcagatcgctccactcattttgcttggtggtgatcatgctgacgccttccgcaatcatgtcatacgcctgccagttgccggtctgagtgtttttgcgccactggaaatccaggcgtaccggcggacgaccgttgggatcgataatcgttacacggataggcacaatggtcgcatcgcccagcggttgctcaggcgctatctggtaagtctggccgtggtacatcgccagcgcctgaccgtatgcctgtttcaggtattcgcgaaacgctgcaaaataggcttcacgctgcgccggggtcgcctctttgtagtagcggcccaacaccagcgcgccggcatattttacctgcacgtacggcagaagttcctgatcaacaacgtctcgcaggtaatccggattggcacgaattttcggctgttcgtttttcaggcgatcaaaagttttctgcgccgcctcgttcatcagtttataaggattgctctgatccgctgccgttgctgcgcttaatggcgcaatgaccagcagggccaccatcatcagtcgtttaaacatgcctcaattctcctgagattatttcgtttcgcccgcgggcgttgtggcttcagtatggccttccgttgcggctggcgcatcgccagaattcttattgtcgtcgcctttgctgttataaaggaactggccaatcatatcttccagcaccattgcagacttggtgtcctgaatcgtactcccatctttgaggatagacgttcccagctcaggatcttcaaaaccgacgtttaatgccagatattgctcccccagcagcccggaagtacgaatactcaacgagctggtatcgggaatatggttataacgctcttcgatgtcgagcgttacgcgcggcaggtatgttttcggatcaagcgagatatcttcaacccgcccgacaaccaccccgccgatgcgtaccggggaacgcactttcagaccgccgatgttatcgaaggtcgcataaaccttataggtcggctccgtgcgcatagaggtcacatttgccgccttcaggcaaacaaacagcgccgccagcaacgctaccagcaaaaaaacgcctacccaaatttcattttttttcgtttgcatgaactcaattcccaaacatcagtgcggtcagcacaaaatccagccccagaacggccaacgatgcgtgaaccacggtacgcgtcgttgcccggctaatcccggcagaagtcggtattgcgtcataaccgttgaataacgcaatccatgttaccgtaatggcgaacaccacgctctttatcagacagttcaccaggtccatacgccagtcgacggcattctgcatcgcggaccagaagaacccggcgtcgattcccttccagcttacgccgaccagcgagccgccccagataccgaccgccacaaagataatggtcagtagcggcaatgaaatcacgcccgcccaaaagcgcggcgaaatcacccggcgcaatggatcgaccgccatcatctccatactggagagctgctccgtcgcccgcatcaggccgatttccgccgtcaacgccgacccggcccgcccggcaaacagcaacgccgcgaccaccggccccagctcgcgcagcagcgaaagcgccactaacatgccaagactggtctccgcgctgtaagtggtcagaaccagatagccttgcagccccagcaccataccgatgaatacgccggagacaataatgataagcatcgacaagacgcccacattataaagctggcgcaccagcagcggcgcatgtttgcgaaactccggcttaccgataatcgcattgaataacattaacccggcgcgcccgaacgtcctgacggttttgatcccgctgtgtccgagtgctgccagcgcatttaacagcatgagtggcttaactccctgtttcgagtaaatcaaggtgatagtcgcccgccggatagcggaacggaaccggcccgtcggcaataccgtcaaggaactgacgcacgcgcgggtccgtattctcctgcaacgcctgagcgctaccgtgagcgacgatttttttgtccgccatgatccaggcgtgatccgcaatactgagcacctctggcacatcatgcgagaccaccacgcaggtcacgcccagcgcgctgttcaattctgaaatcagcttcaccagaacgcccatggtaatcgggtcctggccaacaaacggctcatcgaacatgatgagatccggttccagagcgatggcgcgcgccaacgcggcgcggcgcgccatcccaccggagagctcggaaggcatcagttttgccgcgccgcgcagcccgacagcttccagtttcatcatcacgacgctttttagcagcggcgcgggtaaattggtgtgctcccgtagcggataggccacattgtcaaacacgttcatgtcggtaaacagcgctcccgactgaaacagcatactcatacgtttacggacggtgtagagccgcgaacgggacatggccggcacattctcgccatcaaataagatctcgcccttatccggcgggatctgtccgccaatcaggcgcaacagcgtggttttaccgatgcccgacggccccatgatcgccgtgatcttcccgcgcggcaccgtcagggaaatattatcgaaaatgcagcgttcgccacggcaaaagctgacgtcgcgcatatcgactaaattggccgcagactgacccattgattcatccttcgtattgccttgttgaggtaaccatggcgctgaatttaaccatgggttcgacataattacagaatattaactgacagggttagcgaaagctggcattcgttttactttttagccgcataaagtcaaaattaggacttcgttacggcttccagatatcccttccaggggaccggcgagtatacctgaagaaaggactttagatgcttttagcgatggcgctactcataattggtttgcttctggtggcctacggcgccgatcgtctggtgtttgcggcctctattttatgccgtacattcggtattcccccgctgatcatcgggatgacggtcgtgagtatcggcacctcgctgccggaaattattgtgtcggtcgccgcatcgctacacggtcagctcgatttggccgtcggcgcggcgctcggttctaacatcaccaatattttgctgatcttagggctggcggcgctggttcgtccatttaccgtgcattccgatgttctacgtcgcgaattgccattaatgttatttgttagcgtggtagccggttccgtactgcatgacggacagttaagtcgcagtgatggtatctttctcctgcttctggctgtgctatggctgttattcattgttaaaatcgcgcgtctggccgaacgccaggggaatgacagcctcacccgcgaacaactggcggagctgccgcgcgaagacgggctccccgtcgcgttcttatggctgggcattgcgctggtcatcatgccgatggcgacgcgcatggtaatcgataacgctacggtgctggcgaactatttcgccatgagtgaattaacgctcggtctgacagtcatcgccgtcggcaccagtctgccagaactggcgacggcgattgccggcgtgcgaaaaggcgaaaatgatattgccgttggtaatctcattggcgccaatatttttaatctcgccatcgtgctgggactgcctgcgctgatcgcgccgggggagatcaacccgctggcgtttgggcgtgattatagcgtgatgttgctggttagcgtggttttcgctttactttgctggcggcatccgcgccagattggccggggcgcaggtatactgctgaccggcgggtttatcgtatggctggcgatgctctattggctatcgccacttcttgttggataactggaaacggattatgtcgcatttagcgttgcaaccggggtttgactttcagcaggcaggcaaagaggtcctggaaattgaacgtgaaggcctggcggagcttgatcaatatatcaaccagcatttcacgctggcctgtgaaaaaatgttcaactgcaccggaaaagtggtggtcatggggatggggaaatccggccatatcggacggaaaatggccgccacgttcgccagtaccggcacctcttccttttttgtacatccaggcgaagccgcgcacggcgatttggggatggttacgccgcaggatgtggttatcgctatctccaactccggcgaatccagcgagatcgcggcgctaataccggtgcttaaacggctgcacgtaccgttaatttgcattaccgggcgaccggaaagcagcatggcgcgtgcggcagatgtgcatctatgtgttaaagtgcccaaagaagcgtgtccgttaggcctggcgcctaccagtagtaccaccgcaacgctggtgatgggcgacgcgctcgccgtggcgttgttaaaagcgcgcggctttaccgccgaggatttcgctctgtcgcatcctggcggcgcgctgggacgtaagctactgctgcgcgtaagcgatattatgcatactggcgatgagatcccgcatgttaataaacatgccaccctgcgtgatgcgctgttagaaattacgcgtaaaaatctcggtatgaccgtcatttgcgatgaatccatgaagatcgacggtatcttcaccgacggcgatttacgtcgcatgttcgatatgggcggcgatatgcgccagttggggatcgccgaggtgatgacgccagggggcattcgcgtgcgtcccggtattctcgctgtcgatgcgctgaatttaatgcagtcccgccatatcacctccgtactggttgctgatggcgaccagttactcggtgtgttacatatgcatgatctcctgcgtgcaggcgtcgtgtagaaactcaaggataattaacgatgagtaaagcaggtgcgtcgcttgcgacctgttatggccccgtcagcacccatgtcatgaccaaagcggagaatatccgcctgctcatcctggacgtggatggcgtattgtctgacggcctgatttatatgggcaataacggcgaagagctgaaggctttcaacgttcgtgacggctatggtattcgctgtgctttgacctccaatatcgaggttgccattattaccggacgaaaggctaaacttgtagaagatcgctgcgccacgctggggattgtccatctttatcagggacagtcgaataagctgatcgcctttagcgatctgctggaaaaactggccattgcgccggaaaatgttgcctatgtcggcgatgatctgattgactggccagtgatggaaaaagtggggttaagcgttgccgttgcggatgcgcatccgctgctgatcccccgcgctgactatgtgacgcacattgccggcgggcgcggcgcggtacgtgaggtgtgcgatttgctgctgctggcgcagggcaagctggatgaggccaaagggcaatcgatatgagtaaaaccagacgttgggttatcattctactgtcgctggctattctggtactgattggtattaatctggcggataaagacgatcctgctgccgtgatggtcaacagcaacgatcccacgtataaaagcgagcacacggataccgtcgtgtacagtccggaaggcgcgttgagctatcgtctgatcgcgcagcacgttgaatatttttccgatcaggcggtctcatggtttacgcaaccggtattaaccacctttgataaggataaagtgccgacatggtcgatcaaggccgataaagccaaattgactaacgatcggatgctctatctgtatggccatgttgaagtcaacgccctggtgcctgacgctcaattacgcagaattaccaccgataacgcgcagattaatctggtgacgcaggatgttacctcgaacgatctggtgacgttatacggcacaacatttaactccagcggactgaaaatgcgcggtaacttacgcagcaagaacgccgagctgattgaaaaggttagaacctcttatgaaattcaaaacaaacaaactcagccttaatcttatgcttgccggctcgctgctggccgccagcattccggccttcgccgtcacgggcgataccgaacagcctattcatattgactcggatcaacagtcactggatatgcaaggcaacgtcgtgacctttacgggcaacgtggtaatgacccagggcacgattaagatcaacgccgataaagtcgtggttacccgccctggcggcgaacaggggaaagaggtgatcgacggttacggcaatccggccaccttctaccagatgcaggacaacggtaagccggtgaaaggccacgcttcccatatgcattacgagctggcgaaagattttgtggtgctgaccggcaacgcttatctggagcagcttgacagcaacattaccggcgacaaaatcacctacctggtgaaagagcagaaaatgcaggccttcagcgagaaaggcaaacgcgtcaccaccgttctggtgccgtcgcagttgcaagacaaaaacaaaggccagactccggcgcaaaagaagagtaactaattcgttatggcaacattaactgcaaagaatctggcgaaggcctataaaggccgtcgcgtagtggaagatgtcagtctgaccgttaactccggggagattgtcgggctgctcggtccaaacggcgcgggtaaaaccaccaccttttatatggtcgtcggtatcgtgccgcgtgacgcgggcaatatcatcatcgatgatgaagatatcagtctgctgccgctgcacgcgcgcgcgcgccgcggtatcggctatttgccgcaggaagcctctattttccgccgtctcagcgtatttgataacctgatggcggtactgcaaattcgtgacgatttgaccgcagaacagcgagaagaccgcgccaacgagctgatggaagagtttcatatcgagcatctgcgcgacagcatgggacaggcgctgtccggtggtgaacgccgtcgtgtagaaatagcccgcgcgttggccgctaatcccaaatttatcctgctggatgaaccctttgccggcgtcgacccgatttccgttatcgacataaaacgcattatcgagcatctgcgcgatagtgggctcggcgtgctgatcaccgaccataacgtccgtgagacgctggcagtctgtgaacgtgcctatatcgtgagccagggccaccttattgcccacggtacgccgacagaaatcctgcaagacgaacacgttaagcgtgtatatcttggggaagacttcagactctgatagggtagagggctatgctgctctagcgggagaaaacgactctgaatatgaagcaaggtttgcaactcaggcttagccaacaactggcgatgacgcctcagctacaacaggccatccgtctgttgcagttgtctacgctggaacttcagcaggaactccagcaagcgctggaaaataacccgctgcttgagcaaaccgatcttcatgacgaaatcgacactcagcaacctcaggatgacgatcctctcgataccgccgacgcgctcgaacaaaaagagatgccggaagagctgccgcttgacgccagttgggatgaaatttacaccgccgggacgccgtccggccccagcggcgattatatcgacgatgagctgcccgtctatcagggcgaaacgacgcagtcgttgcaggattatctgatgtggcaggttgagctaacgcccttctcggacaccgatcgcgctattgcgacatccattgtcgacgcggtagatgataccggctatctcaccgtatccctggacgaaattcgcgaaagcatgggcgatgtagaggtggatctcgatgaggtcgaagccgtcctgaagcgtattcagcgttttgatccggtaggcgtcgcggcaaaagatcttcgcgactgtctgctgatccagctttcacaattcgacaaatccacgccgtggctggaagaggcgcggcttattatctgcgatcaccttgatctgctggccaaccacgatttccgcacgttgatgcgcgttacccgactaaaagaagaggtgctgaaagaggcggtaaacctgattcagtcgctcgatcccagacccggtcaatcgatccagaccggcgagccggagtacgttatcccggatgtgctggtacgcaagcataacggtcgctggacggtggagcttaatagcgacagtattccccgtttacagattaaccagcactatgccgccatgtgcaatagcgcgcgcaacgatgccgacagccagttcatccgcagtaatttacaggatgcgaaatggctgataaaaagccttgaaagccgtaacgacacgctgctgcgcgtcagtcgctgcatcgtcgagcaacagcaagccttttttgaacagggcgaagaatatatgaaaccgatggtactggcggatatcgcccaggccgtcgagatgcacgaatccactatatcccgcgtgaccacgcagaagtatttgcacagcccgcgcggtatttttgaactcaaatatttcttttccagccacgtcaataccgaaggcggaggcgaagcctcttccaccgcgattcgcgcgctggtgaagaagttaattgcggcggaaaaccccgcgaaaccactgagcgacagcaagttaacctctctgctgtcagaacaaggtatcatggtggcacgccgcactgttgcgaagtaccgagagtctttatccattccgccgtcaaaccaacgcaaacagctggtttgacccaaccgataaggaagacactatgcagctcaatatcaccggacataacgtcgaaattactgaagccctgcgtgaatttgtgacgacgaaattcgccaaacttgaacagtattttgagcggattaatcaggtatacgtggtgttgaaagtggagaaggtcacgcacatctcggatgcgacgctacacgttaacggcggcgaaattcacgccagcgcggaaggccaggatatgtatgccgccattgacggcttgattgataaactggcaaggcagttaaccaagcataaagataaactgaaacaatactaattgtccgggcagttagccagtgcaggacggcctgttgtgtgacacaacgggccatttgtacagttagcgctccgaacctggccatcaacctgacaggacaggttcttaggtgaaattatgataaataacgatacgactctacaactgagcagtgtacttaaccaggagtgtacgcgtagcggcgttcattgtcagagtaagaaacgcgcgctggaaatcatcagcgaactggcggcaaaacagctcagtttacctcctcaggtcgtgtttgaagccattctgacacgcgaaaaaatgggcagtaccggtattggtaatggtatcgccatcccgcacgggaaactggaagaagataccttacgcgccgtcggcgtgttcgttcagctcgaaacgccgatcgcgttcgacgccatcgataaccagccggtcgatctcctcttcgctctgctggtgcccgccgatcaaactaaaacgcatctgcacacgctgtcgctggtggcgaaacgtctggcggataaaacgatctgccgccgcctgcgcgcggcgctgaatgatgaagagctgtatcaaatcattactgacaccgaaggtgagcagaatgaggcataacaactcaatggcatttatttctgtcgttgtgaggagaaacggtacatggtactgatgatcgtcagcgggcgttccggatcaggtaaatctgtcgctctgcgcgcgctggaagatatgggattttactgcgtggataacctccccgtcgtgctgttgcccgatctggcgcgaacgctggccgatcgccagatttccgccgccgtcagcattgatgtgcgcaatatacctgaatcacctgagatttttgaacaggcgatgaataatctgcctggcgctttctcgccgcaattgctgtttcttgatgccgaccgcaataccttgattcgccgctacagcgacacgcgccgtttgcatccgctttccagcaaaaatctttctttggagagtgcgatcgataaagagagtgacttgctggagccgttacgctcacgtgcggatctgatcgtcgacacttcagaaatgtccgtccatgagctggcggagatgctgcgtacccggctattgggcaaacgcgagcgcgaactgacgatggtatttgagtccttcggctttaaacatggtatcccgattgatgcggactatgtgtttgatgtccgctttctgcccaacccacactgggacccaaaactgcgccccatgaccgggcttgataagccggtagccgcgtttcttgaccgacacacagaagttcacaattttatctatcagactcgcagctatcttgagctatggttaccgatgctggagaccaacaaccgcagctaccttaccgtcgctatcggttgtaccggcgggaaacaccgttcggtgtatattgcagaacagctggcagactacttccgctcgcgcggtaaaaatgtccagtctcgccatcgcacgctggaaaaacgcaaaacatgaccgtaaagcaaactgttgaagtcaccaataagctgggcatgcatgcccggcctgccatgaagcttttcgaactgatgcagggttttgacgccgaggtgctattacgcaatgacgaaggcaccgaagcggaagcaaacagcgtcatcgctctgttaatgctcgactccgccaaagggcgtcagatcgaaattgaagccaccggcccgcaagaagttgaagcgctggcggcggttatcgcgctgttcaattccggctttgacgaagactaaacctccccctctataccctatttaccccaacgccgtcccggtatttgatggcagtccccccaaaaccggacgtgttacgcctgcctcttgtcccgcagccccaccctttcgtaaggtttgtacatttcgtgcgctttaattatgcataaaaacattaagaaaaccttaaaaaatttcgtttaggttttatttaagttctttgtccatactaaatttatgtgaataaatttttccaggacttgccatgatccttttatccaaacagactccgctgggcgctggtcgacatcgtaaatgctatacgcatccggataatgcccggcgttgcataaaagttatttacaaccgtgaccacggcggtgataaagagattcggcgtgaactgagctactatgcgcatctgtcccgctacctgacggactggagcgctatcccccgttattacggcacggtagaaaccgattgcggcaccggctatgtctacgacatgattaccgatttcaacggcgcgccctctattaccctgaccgagttcgccgcgcaatgtcgttatgaagaggatgtcgctgtcctgcggcggctactgaaaaaactgaaacgttacctgctggataaccatattgtgacgatgtcgctgaagccgcaaaatatcctgtgccagcgtatcagcgagtcagaagtggttccggtggtttgcgacaatctgggggaaagtacctttatcccgctggcgacctggtcaacatggtgctgtgaacgcaaactggagagagtgtggcagcggtttatcgcccagcctgcgctggccgttgccctggagagggacgcgcagccaaaagacaagaaacggctggcgcttacttctcacgaagcttaatggcctgtgcttatcaggcctggacgacacagatcgcaggccggataaggcgttcgcgccgccaatcggcaaaattaattaagctggttgcgcgtcataaaagattccccgcccagttggcgcatctggcgcataatccacgcctgccggctacgcacatagccagaaggcgcattcgccttatagcgtaacggatttggcaataccgccgccagcaacgcggcttcagacacactcaagcgactggcaggtttatgaaaataccgttgtgccgcagcctccacgccaaaaataccatcaccaaactccgcgatattcagataaaccgtgaggatgcgctttttgctccagacagtttcaatgcccagcgttagcccggcctccagacctttgcgcacccaactgcgtccatcccataaaaagagatttttcgccgtttgctgcgaaagcgtagaggcgccgcgaatacggctctcattccgctcattatgcgccagcgctttttcaatcgccggaacatcaaagccccagtgctcagggaacttctggtcttccgccgcaattaccgccagccccatccacggcgagatatccgccatactgacccagtcagaatgcgccacataaccgaactctccgccgagccaggcgctaatctgccgttccgccatcaccgccgaaaaaggcaccggaaccacgctaaacagcgcaatgccgccgccccaaaagacggcgagcgcagcaaggatacgtaaaagtagacggcgcaaaaacgttaacggcgcgatgcgtcgtttgctcattccgccagaaccagcacgcgcgacactaatttatcaatgccgcttgccgcctgggcgatatcctgcgccagcatataggcaggggtggtcacgaccttgttatcctcgtccacaacgatatcatcaaccgggcaaggtacgtgttcggcccccatctcttcaagtacttcagcggtatcaatatccgtccctattgtcagacgtagcgggaagtcaaagattttcggcaacattgcgggcgcgatacagatgaatcccagcggcttgccggactggtgcatggccttcgccagcgcgacgacatcgctatccacccggcattcgctccccttgctggcgaaattactcaggttcttcgccgcgccgaaaccaccaggcacaatgagcgcatccagttcctctggctgagcctgggacagaggacgaatatcgccccgcgtaatacgcgccgcctcaatcaggacgttacgcgtttccgccatagcttcgccggtcaggtgattaataacatccgcttgtggtttatccggcgcgaagcagatagcctgcgcgccgctgcgggcaatggccaacagcgtcagaacggcctcatgaatttcggtgccgtcatagacgccgcatccgctgagcactacgccaatttttttcatggtgaacatcctcctgcaaccgactcaagcccattaataattttgattaaaatgctacgcttcacacatttaaatgattcatgtaacaaatcatttaggatttgctatcttaactgcgtgcggcctgaaaacaggactgcgcctttgacatcatcataataagcacggcgcagccacgatttccctggtgttggcgcagtattcgcgcaccccggtcaaaccggggtcattttttttccgcgtttgccacccaggctttcagcaccgcgacatcgtgctgccactcctgcttcatctcttcaatccattccacaacattatcttcccaggcgggaagatccggcgactggatttgctggccaagttgttgcagatgacgcagccctaccgaaccggcggcgcctttaatcttatgcccttcctcaacgacgccttttttgtcacgcgccgtcagattggactccagcacgcttaaatagccaagcatcattttttcaaacaccgcgaggccgtcggtgatcaatttaggcccaaccaactcgatgtattgttccagcatcgggatatccagcagcgcttgcgctttatcgctctcttcaggcgtcacggtactctcctctttatcggtggcatcccagaattttttaatcatcgcggttaaggctggcaccgacagcggcttactcagcacatcgtccataccagcgtccagatactcttttttatctttcagaacgttagccgtaagcgctaccagcggcggtaaatcttcccgcgtgtggcgacgggtcagttctctggcaatatccagacccgtcatatccggtagctgaatatccagtaagaccaggtcatattcgcctggcgcgaacatctccagcgccgccttgccggtcatcgcgacatccacgctgttccccagtttttccagtactgaacgcgccacaatcacgttcagttcaatatcttcgaccagcagaacatgcagcgcgggcagcggcatgtcgtcttcatcaaaggcgtcctccacctcttccgccaccgctggcgcatgaaccgttagcgtaaaggtcgatcctttgcccggcagactggaaacggtaatatcgccgcccatatttttcgccagccgacgggagaccgccagcccgataccggtccccgtcgccggcttaccgccatgactgtcttttacctgataatacatggcgaaaattttatcctgctcatcctgcggaatgccgatcccggaatcttccacttcaaagtgcagcatgtcgccttcatcataacgcgcccgcaccgtcacctggccctgctgagtaaacttcaccgcattgctgatcaaattccataaaatctggcgcagacgcgttccgtcggtaatgactttgtgcggcagcggcagcgtcggctcaagcacaaaacgtagccctttttgctgcgcctgcaaaccggaaaggttttccagatcggccataaagctggtgaaatcaaccggttggttatcaagctgaaccttacgccgctccatcttatccatatcaatgatatcattgaaaatattgcctaacgtcacggcggagacatggattgtcttaaggtatttttcctgttcggcggtaagatcggtatccagcaggatgcggcttaaaccgacgataccgttaagcggggtgcgcagctcatgactgatggtagagataaatgtggtcttgtcgcgactggcgcgctccagcgcgtcctgataacgcttacgttcggtaatatcacgaccaaatcccatcaggccatgacgtttaccgacacggtcgtaataaggcactttacgaatttcaaagcaggcctttcgtccgtccggataatccagccactgttcgtaggtcagggagacgttatggcggaatactttttcatcggtttcaatgactttctccgccgcttcgggagagtacacatcttccggcttcaaatgcaccagctgtttttcgctcttgccggttagcaattccattgcgcggttacagccggaaaactctttatcctcattacgataaaaaaccaaatccggcgaggcgtccagaaaggagcgcagaaaagaggattgctgttctagctggatttgcgcctcttcacgctctttaatttctacttttagctgttcaaatgtctcttgcagctccgcttccgctttttcgcgatcggcaatttcctgattaagctgggcaatattgtccttcaactgtacgttaagcttgagatcgcgctcgcgcatctcctccagcttttgcaccagacgcgacagtcgctgccttgactcttccagttgttcaacaacaacggataagaaatagaccgcccagggcgtaattaacaggccaaaaaagatggaacgaataacgtcgatactttcaacctgaccatgcagcaccatggtcaccgccatctgcacgacaatcgccagcaccaccaatgccaacgccaggagcatggaaaagcgcaccagacccaatttcatcatcaggtcgacatagtattgcgccagcatacgaatttgcttcatagaggattccttcaccacaacttcgcacataatacccaattatgggaaccgcgttgaatattgtgcgaaatatgcgtagccccctcatcacgctacgctacaggtggtatccagggacgggccagcgcagagccctgcacgccatgctcattcaggtatttgtccagctcaaccatccccgtccagcgattctcgcaccacagcggggcaagcagcgtcggacggcgagcgctggctgaaattcggtgataaattacctccggcggcgtatgacgaatcatctcacctgccgttagcgtgtagtcgtccagttcgatgccgttcagccgccccgcttcccaggctttggccatcgtactgcctttcacaatatgcagcggatgcagtttaataccgtcaacgcccgtctccaccacacgctccatggtttgcaggcattctgcctgcccttctcccggcagccccacaatcagatgcgcgcacactttcagcccgcgctcccgggcaatccgggtggtacgctgatagcaggcgaagtcatgcccgcggttaattcggcgcagggttttatcgtgcgcggtttgcaatcccagttccagccacacctcgtagccttgatctttatattcacacagtaaatctactactgcctgcgggacgcaatccggacgcgtaccgacgcataacccgacgatactggcctggctgaccgcctgttgatacatggaacgcagcacctgcacttctgcaaaggtgctggtgtaggcctggaaataggccagatagcgtttagcgcggttcaccagatgcgcctgatgcgcaagctgctcggcaatcgaatgatgctgctgcgcctcatcggcaaaagaggcgacattacagaaggtgcaaccgccacgcccgatggtgccgtcgcgattagggcagctaaaaccgccatgaagcgtcagcttatgaaccttttgcccataccgacgtaaaagatccccaccaaacatattgactaatttctgtaactgcataatctgatagaccgcctcttaaaaagaggccaaagcctgccatttttagtctcctttggcgatgacctggatcaatcgtcccggaaggcttttatccattgcataatcaagcaaaataaacgatatttcattcataatcccgctgatgatttttcctgatattcccctcttttttcagcgtctgctgggtcatcgataaaaacagtagcattcaatgctgttcacgcttaaaacagcataaaatgccaagatttttgaaaaagcaaggtcagataactcctggcgagcggctcttatagtgagacagatcacaggctttctgccgctccgtattagcaaccactctataaaaaaccttttaatttcaatagattaaaaagttatctgtgctacagcacacttttgcataaatcagtttgccatttgacctgggtgtggattcccgataagttggggatccgctggaagctttctggatgagccgtctgctcatcatatttatgcagtaattgagattccctcttaaccgtatttaccaatgcgcaaaggacacaaagagggcgaatgcgaggtaagcgtatgatgcgccagccccgtcgccatgctcttgctgtgcccgcgcgccgtcggttgggagagcgtcccgtagagcctggggaggttcactgatatgttgtacgataaatcccttgagaaggataactgtggtttcggcctgatcgcccacatagaaggcgaacctagccacaaggtagtgcgtaccgccatacacgcgctggcccggatgcagcaccgtggcgcgatccttgccgacggtaaaaccggcgacggttgcggcttgctgttacaaaaacctgaccgtttctttcgcatcgtggccgaagagcgcggctggcgcttagccaaaaactacgccgtcgggatgatctttttgaataaagatcctgaactggccgccgcgtcacgccatattgtcgaagaagaattacagcaggaaaccctgtcgattgtcggctggcgcgatgtgccaaccaatgaaggcgtgctcggtgaaatcgccctctcctccctgccgcgtattgagcagatttttgtcaacgctccggcgggctggcgtccgcgcgatatggagcgccgtctgtttatcgtccgccgacgcattgaaaaacgtctgcaggacgacaaagatttctacgtatgcagcctgtcgaacctggtcaacatttataaaggtctgtgtatgccggcggatctgccgcgcttctacctggatcttgcggatctgcgtctggaatcggccatctgcctgttccaccaacgcttttccactaacaccgtgccgcgttggccgctggcgcagccgttccgctacctggcgcataacggcgagattaacaccatcaccggcaaccgccagtgggcgcgcgcccgtacctataaattccagacgccgctgatcccggatttacaatccgctgcgccgtttgttaacgaaaccggttcggattccagctcgctggacaacatgctggaactgctgctggcaggcgggatggacattatccgcgccatgcgcctgttggtgccgcccgcctggcagaacaaccccgatatggaccaggatctgcgcgccttctttgactttaactccatgcatatggagccgtgggacggtccggcaggcatcgtgatgtccgacgggcgcttcgccgcctgtaaccttgaccgtaacggcctgcgcccggcacgctatgtcattaccaaagataagctgatcacctgcgcctccgaagtcggtatctgggactatcagccggatgaagtggtcgagaaaggccgcgtcggcccaggcgagctgatggtgatcgacacccgcggcggacgtattctgcattccgcggaaaccgatgacgatctgaaaagccgccatccgtataaagcgtggatggaaaagaatgttcgccgtctggtgccgtttgaagagttgccagatgaagaagtcggtagccgcgaactggacgatgacctgctcgccagctatcagaaacagtttaactacagcgccgaagagctggactccgttatccgcgtgttgggcgaaaacggccaggaagccgtcggttcaatgggcgacgataccccctttgccgtgctctccagccagccgcgtattatttacgactacttccgccagcagttcgcgcaggttactaacccgcctatcgacccgctgcgggaagcgcacgtcatgtcgctcgccaccagcatcggtcgcgaaatgaacgtcttctgcgaagcggaaggtcaggcccatcgcctgagttttaaatcgccaattctgctgtactccgatttcaaacagctcaccaccatgagcgagcatcactaccgcgccgactggcttgacattacctttgatgtcaccgaaaccacactggacgcgacggttaaggcgctgtgcgataaagcggaacagatggtgcgcaacggcaccgtgctgctggtcctctcggatcgcaatatcggtaagaatcgcctgccggtccccgcgccgatggcggtgggcgcggtgcagactcgtctggtcgatcaaagcctgcgctgcgacgccaacatcatcgtagaaaccggaagcgcccgcgatccgcatcactttgcggtactgctcggctttggcgcaacggccatctatccgtacctggcctacgaaacgctggggcgtctgattgatacccaggccatcgctaaaaactaccgtaccgtgatgcagaactaccgtaacggcatcaacaaggggctgtacaagattatgtccaaaatgggcatttcgaccattgcctcttaccgctgctccaaactgtttgaagcggtcgggctgcacgatgatgtggtaaacctgtgcttccagggcgtggtcagccgtatcggcggcgcgagctttgatgacttccagcaggatctgctgaatctctccaaacgcgcctggctggcgcgcaaacccattagcccgggcggcctgctgaagtacgtccacggcggcgaatatcacgcctataacccggatgtcgtgcgtaccctgcaacaggcggtacagagcggcgagtacagcgattatcaggaatacgccaaactggtcaatgagcgtccggctgcaacgctgcgcgatctgctggcgatacatccagacggcgaggcggtgactatcgacgaggttgagcccgccagtgagctgtttaaacgctttgataccgcagccatgtctatcggcgcattaagtccggaagcgcacgaagcgctggcggaagcgatgaacagcctcggcggcaactccaactccggcgaaggcggcgaagacccggcgcgctacggcaccaataaagtgtcgcgtatcaagcaggtggcttccggccgttttggcgtgacgccagcgtacctggtcaatgccgatgtgattcagattaaagtcgcgcagggcgcgaaaccgggcgaaggcggtcagttgccgggggataaagtcactccgtatatcgctaaactgcgctattcagtgccgggcgtgacgctgatctccccgccgccgcaccacgatatttactctatcgaggacttagcgcagctcattttcgacctcaaacaggtcaacccgaaggcgatgatctccgtgaagctggtgtccgaaccgggcgtcggcaccatcgcgaccggcgtggcgaaagcctatgcagacctcatcaccatcgctggctacgacggcggtaccggcgcaagcccgctctcttcggtgaaatacgctggctgcccgtgggaactaggacttgttgaaacccagcaggcgctggtcgccaacggtctgcgtcacaagattcgtctgcaggtggacggcggtctgaaaaccggcgtcgatatcatcaaagcggcgattctcggtgcagaaagtttcggcttcggcaccggcccgatggtggcgctgggctgtaaatacctgcgcatttgccatctgaacaactgcgcaaccggcgtggcgacgcaggatgaaaaactgcgtaagaaccactatcacggcctgtcgttcaaagtgaccaactactttgaatttatcgcccgcgaagtgcgcgagctgatggcttcgcttggcgtgacccgcctggtggatttgattggccgcaccgacctgctgaaagagctggagggcttcaccgctaaacagcagaagctggcgctgtctcgtctactggaaaccgctgaacctcatccgggtaaagcgctgtactgcaccgagaataacccgccgtttgataacggtgtgctgaatgcgcaactgttgcagcaggcgaagccgtttgtcgatgcgcgccagagcaaaaccttctggttcgacatccgcaacaccgatcgttccgtgggtgcgtcgctttccggttacatcgcacagacccacggcgatcaggggctggcttccgatccgattaaagcgcacttcagcggtaccgcaggccagagctttggcgtgtggaacgcgggcggcgtggagttatatctgactggcgatgccaacgactatgtcggtaaaggtatggcaggcggtttgatcgccatcagaccaccggtaggttccgccttcctcagccataaagccagcatcatcggcaacacctgcctgtatggagcgaccggtggccgtctgtacgcggcggggcgcgcgggcgaacgtttcggcgtgcgtaactccggggcgattaccgtagtagagggcatcggcgacaacggctgtgaatacatgaccggcggcatcgtctgcgtgctgggtaaaaccggcgttaacttcggcgcggggatgaccggcggcttcgcctatgtgctggacgaagatggcgaattccgtaaacgcgtgaacccggaactggtagaagtactggacgttgattcgctggctatccacgaagagcatctgcgcggcctgatcaccgagcacgtgcaacatactggttcgcaacgcggcgaagagatcctgtccaggtggtcaagcttctcaacccaattcgcgttagttaagcccaagtccagcgatgtcaaagccctgttgggccaccgtagtcgtagtgcggcagaattgcgcgtgcaggcgcagtaaggaattgaaatgagccagaatgtttatcaatttatcgacctgcagcgcgttgatccgccgaagaaaccgctgaagctccgtaagatcgagtttgttgaaatctacgaaccgttttctgaaggtcaggcgaaagcccaggcggatcgctgtttgtcctgcgggaacccctactgcgagtggaaatgtccggtacataactacatcccgaactggctgaaactggctaacgaagggcgtatttttgaggcggctgagctatcgcaccagaccaacaccctgccggaagtgtgtggccgcgtctgcccgcaggaccgcctgtgcgaaggctcctgtacgctgcacgatgagttcggcgcagtgaccatcggtaacattgagcgctatatcaacgataaagcgttcgaaatgggctggcgcccggatatgaccggcgtgcgccagacggacaaacgggtagcgattatcggcgctggtccggcagggctggcgtgcgccgacgtgctgacccgcaacggcgtgaaggcggtggtctttgatcgccatccggaaatcggtggtctgctgaccttcggtattccagctttcaaactggaaaaagaggtgatgacccgtcgtcgcgagatcttcatcggcatgggtattgagttcaaacttaataccgaagtgggtcgtgatgtacagcttgaagatctgctgaaagattacgatgcggtattccttggcgtcggcacctatcagtcgatgcgcggcgggctggaaaatgaagatgcggacggggttttcgacgctctaccgttcctgatcgccaatacgaagcagatcatggggtttggcgaaaccagcgacgaaccatatgtcagcatggaaggcaaacgcgtggtggtgctgggcggcggcgataccgcaatggactgcgtacgcacttccatacgccagggcgcaacgcacgtaacctgtgcttatcgtcgtgatgaagagaacatgccgggttccagacgcgaagtgaaaaacgcgcgcgaggaaggtgtcgagtttcagtttaacgttcaaccgctgggcattgaagtcaatgccaacggcaaagtgagcggcgtaaaaatggtgcgcactgaaatgggcgaaccggatgccaaaggccgtcggcgggcggagatcgtcgccggttccgagcatgtggttccggctgatgcggtggtgatggcgtttggttttcgtccacacagcatggaatggctggcgaaacacagcgtggaactggactcgcagggacgaattatcgcgccggaacgcagcgataatgctttccagaccagcaacccgaaaatcttcgccggtggcgacatcgtgcgcggttccgatctggtggtgacggcgattgccgaaggccgtaaagcggctgacgggattatgaactacctcgaagtgtaaccctttcggctccccggttgatgccttgtgctgatggctggggagccgatattcctctcctcaatatctctcctgccgattctggaaacccgctcgtaaatcgagatgtaatgccatgtaaaatccgttcatggattgattcgtttacgcctgaagcgtattgatagcgttctaatttcacaatgaaactatcacgtaagggatgacatgacgaatccaactttagcgccacagtctgatgaatatcagcaaattcatgacggtattattcgtctggtcgatacggcacgtaccgagaccgtgcgcagcatcaatgccattatgactgccacctactgggaaattggccgacgtattgtcgaatttgaacagggaggagaagcgcgagcggcctatggcacccagcttatcgaacgattatcggtagatttaagtcagcgctataagcgcggtttttccaacagaaacctatggcaaattcgtacattttatctttgttttcaacacattgaaattccgcagacactgtctgcggaatcttcaaatctcataccgctcgccaaaacattccctcttccctggtcagcttatgtgcgtctgctgtcggtgaaagataacgatgcccgcactttttacgagaaagagacgctacgtaacggctggtccgtacggcaactcgatcggcaaatcgccactcaattttacgaacgaacgctactgtcccacgacaaatccgccatgttgcagcagcctgcacccgccgagccaaacgttttgccggagcaagccatacgcgacccgttcattctggaatttcttaacctgaaggacgagtattccgaatcagatctcgaagacgcgctgctcagccacctgatggactttatgctggagctcggtgacgattttgcttttgttggccgccaacgccgactacgcatagacgatagctggttccgcgtcgatctgctgttcttccatcgtcgcttgcgctgcctgttgctcgttgacctgaaggtaggcaaattcggttatgcggatgccgggcagatgaatatgtacctgaactatgccaaagagcactggacaatgcccggagaaaacccgccagtcggcctggttttgtgcgcagggaaaggcgcgggggaagcgcattacgcgctgactggcctgccaaacaccatcatggcgagcgagtacaaagtgcagttgcccgacgaaaaattactcacagacgaacttattcgttcgcaaaccatgctggaaactcaactcacacgcggtggttcactgacaacggagaaaaactagcgaaccattaatgccatgaataattatcaaaaaaaatatcacacgaaaacgtttgctttattctgagaactgtatattatgcggcggattttttgggcaaaattcatggaggcgttgtgtcgcaggacaacaattatagccaggggccagttccccaggcggcgcggaagggcgtgattccactgacgtttgtcatgttgggtttaacgtttttttccgccagtatgtggaccggagggacactcggcaccggtcttacctatcatgatttcttcctcgcagttttcttcggtaatctcctcctcggtatctacactgcatttcttggctacatcggcgcaaaaaccggactctccacccacctccttgcacgttactcctttggcgttaaaggctcatggcttccctcactgctgttaggcagtactcaagtgggctggtttggcgttggcgtagcgatgttcgctattccggtcagtaaagcgacgggcattgatgccaatatcctgattgccgtttcgggtctgctgatgaccctgaccatttttttcggcatctcggcgttgaccattttgtctatcgttgccgtacccgcgatcgttattctgggcagctactccgtctggctggcggtcagcggcgtgggtgggctggagcatttaaaaacgatagtgccgcagacgccgctggatttttccagcgcgctggcgctggtggtgggctcgtttgtcagcgccggtacattgaccgccgacttcgtccgcttcggacgtcatgccaaaagcgccgtactgattgcgatggtcgcttttttcctcggtaactcgctgatgtttatcttcggcgcggcaggcgctgccgccgtcggtcaggcggatatctctgacgtgatgatagcgcaggggctgctgctgcccgcgattgtggtgcttggcctgaatatctggaccaccaacgataacgcgctgtacgcatcgggtctgggcttcgccaatattaccggtctttccagccgcacgctgtcggtggtgaacgggattatcggtaccgtgtgcgcgctgtggctttacaataattttgtcggctggctgacgttcctgtcatctgccatcccaccgattggtggagtgattattgccgactatctggtgaaccgccgccgctatgccgacttcaacaccgtgcgctttattcccgttaactggattgctattctttccgtcgcgctgggcatcgccgccggacattatgttcctggtattgtgcccgtcaacgccgtactcggcggcgtcttcagctatatcctgctgaatccacttttcaaccgcagccttgctaaatcaccagaggtcagccatgcagaacaataacatcactattcgtcagacgcgtctgcagggacacgaaggattatggcagattacgattgaaaacgggcgctttagccggattgagcctcaggaagccacatcgttaccgcagggcgaagtgcttgatgccgaaggcggtctggctattccaccgtttgttgagccacatatccacctggataccacgcaaacggcgggtgaaccgagctggaaccagtccggcacactgtttgaagggattgagcgctgggcagaacgtaaagcaatgctcacgcatgaagatgtgaaagcgcgcgcgatgcagaccctgaaatggcagatggctaacggcatccagtacgttcgtactcacgttgacgtttcagatcctacgctcaccgcgctgaaagccatgctggaagtgaagcaagaggttgcgccgtgggtagacctacaaatcgtcgcctttccgcaagaaggtattctgtcttatcccaacggtgaagcgctgttagaggaagccgtgcgtttgggcgctgacgttattggcgccattccgcactttgagttcacgcgggaatatggcgttgaatcgctgcacaaaaccttcgccctggcgcaaaaatacgatcgcttgatcgatgtgcactgcgacgaaattgatgacgagcagtctcgctttgtcgaaacggtcgcggcgctggcgcatcgtgatggcatgggggcgcgcgtgaccgccagccacaccacggctatgcactcgtacaacggcgcgtatgcgtcacgcctgttccgtctgttgaaaatgtcggggattaacttcgtcgccaacccgctggtaaatattcatctgcaagggcggtttgacacttacccgaaacgtcgtggcgtcacgcgagtgaaagagatgctggaagcggggatcaacgtctgctttggccatgatgacgtcttcgacccgtggtatccattaggcaccgccaatatgctgcaggtgctgcatatggggttacacgtttgccagttgatggggtatgggcaaatcaacgacgggttaaatctgatcactacccacagcgcaaaaactttgcacctgcaggactacggtctgagcgtcggcaatgccgcgaatctggttatcttacccgctgagaatggattcgatgcggtacgtcgccagacgcctgcccgttactcaattcgccacaggcgggtgattgccgagacggtgccgagccagacgacgctgcacctgacccagccggaagccgtgacgtttaagcgttaacccgtcatacccgcgctctccggcacattcaccacgcagcccgtaaggggctgcgttcggaagactgctccggcaagagattcaggccgccagcaaactggcgcgtactttcactaccactttcttgatgtcatccggttcacccactgcacatcccggtttatgcggttctcccggcataaacacagcaaacatccccgcttgcagcgtaatagtctgctcgtcggcaatttgactacaaagctggtaatcctcttcaacgtgcatctcctcgcactggcgagcggcaccggacatcccaaacgcaatacgctcgacgccggttagtagtagctgaatatcaatgtattgttcatgcaattccgctttcttcccggcaggcatttgcgtcgttaactgcattacattcataaagatattgtcgccctgcaattcatagcgccccggtgctttctcctgcggccttgccgccagcgcgagagtcaaggcatccagcagtcgcggatgcaacccgcaagaaggcaacgactgtacttcccccatcatcataatgtgtctccttgagctaacaaagcagcgcctaataatcctgcgtcatgccgatagcgagcggcgctcagcgccacgtgataaggctcaggctcttgcatcaaaaacgcgcgaacctgctccaggtatccctcagctaaccctacgctgccgccaatgaccacacactggcagtcggtaatcgctttcacatcggcgatcattcgcgctattacctgcgcggattggcttaccagatgtcgcgcctgctgatgaccttcgccagcgcgaataaatagggttttggcgtcgcatcccgccagatcgtcccgcgccgccgcggccatccctcgtccggaggcgatggcctctacacaaccaacgcgtccacagccgcatacgggcccgtgtgggtccgccagggtgtgtcccaggtgcccggccagaccgccttttccggtaaggagcttgccgtcgcagacaacgccgccgccaacgccggttgaaacggtgataaataccatatcgcggatatcatcagggagcgcgtgatactccgcccaggccgccgcctgcgcgtcgttcaccgccagcgtcggcaggccagcgatcgtttccagtgtttgtactaacggaaagtgtagcaagccgcccagattatgggggtttagcgccagcagcatcccttcctgaatgatcccggtagaagctatcgctacctgacgcgcctctgcccgtagtggttcaaccagcgcctttaatgcttcacgtaacgcatccggcgttttgctcgcgggggtcggtagctcgcgacgctggctaatgcgcaagttgttgtcgatgagcgcggcggcaagtttagtaccgccaatatcgattgctaacgtagtcatgacgccgccttttttaatgcgtcgttataccatccacagatatgttccagacgggtaatggcggaccccaccgtcaccgcccatgcgccatagcggatcgcctccgccgccagtgctggcgagttatagcgcccttcggctattacccggcatccggcgtcatgcaacgctttgactaagggcagatcgggttcctccggcgtatcgggggtggtgtagccggacattgtcgtgccgataatgtccgcgcccaaccgttggcaggcgagaccatcgtccacggatgagcagtcggccatcgccagtagatggtggtgatgaatgcgcgccaacaacgcctcaacggctaccggccgttgccgagcggttccatcaacggcgataatagctgcgccagcgcatctacatcgtcgagaaaaggggtaatgcgcactggagagtcgtccagatcgcgtttgataatgccgataatgggtaccgaaacgagcgaacgggccacgcgcaggttgtctatgccttcaatacgcaccgcaaccgcgcccgcctgttccgccgccaacgccattgccgctacaatctccggcttatccagcggactgcccggaacgggctggcaggagacaatcaggccgccagaagcggcaatatttttatccagttgttcaagtaacgacatactactcccttacaaatattgcccgattgaaaaccgggcaagcggattaacttttcgtttttacaaaggcacctttaccactgccaagcggtacggctccgctgaacgttttgtcgtcgatagcatcatgggtgcgtaacgcttccggacgtagccaacgctgtacgcgagacggcatatcaagcccaataagcaggatcacgacaaacgtcaggctgaaagagagcgatgccagcgcagtgcccagatccagacgttgagcgatcagcgctcccaggatcggtgccagcgcgccgccgagcgcgccgacgttataagtaaagcccagccccgccgcgcgctgatcggtatcgaagtaaccgccgatcagtttcggcagaatcccggcaatcccctgccccaacatctgttggaaaaacagtagcagacccagaacccagacgtttgtgccgccaatcgcaaagaccggaataatgaggatttgcgaggccagcaggctacagacatatgctttacgcgttcccagccagtcgccaagaaaaccgcctacgcaacaaccaaccgccgcgccaaatccgctaaagaacaggacattcgccaccgtatgcggatcgtaggccagctcggttttcagataagtaggtaatagcgcctgaatcggccaagaatagaggaaagcaaacagtaccaccagcatcagcatgacgccagtgggccagcgtttaccgctgctctgcaccataaagctgataaagataaccgcgcacagtagtcccagccccgccacaatcgcagcattttgtaggttaccggcaaaacagaaccacagcgcagcggcggcggcgaaggtcattaaaatgttgatgatacgatgttcgccccgataaagaatgtcgaccatcgtgcgtaccggcgctttacccgcgtgtttttctttccagtcttccgcttccggaatgtttttccgcagccagagggcgaagataattggcaaaatgccaatgaaaaacagcgcgcgccagccccagacaggcaccaccaggctgtacacctgcgcggcaacgaccgcgccgacggagaagccggaaatcagaaaaccactggctttattgcgtaaatgttttggccagctttcaatcacataggtcgcgctggaaccatattcgcccgccatgcccataccaatcaccagtcgggcgatgaacatggtggtgtaaccgggcgcaaacccgcaggccagggttcccaccgaaaacagaatgatgctgctgaccatcgccagacgacgcccatagcgatcgcccatcgcgcccaataataacccgccgaaccagcgagagataaaagccgcagaaatcaggcttgccgcctgtaccgtcgtcagcccaaattcgctttgtacctcagtcagtacaagagcaattaacacaaaatcaaaaccatcaagcagatatcccaaccaggcagcggaaaatgcccgccattgcgcccggttgagatggcgataccacgggatgttctgggtagaagtactcattttactctcccgacgatttttgttgtcgttatgccgaatggcggctccgccttatccggcctactgttcgcactgttgtaggccgggcaagcgtagcgcccccggcattatgctgttacgccttttcttccatcagttgttgagccagcgccttgagcgccggcagatatttttcatcaacaggcgcaaacggtttacgacatagcggcaccgataccacgtccatataatgcaggaccgttttcaggccgcggaatacgccggttttaatcagtaaatcaataaccttattgcactcggtttgcagacgctgcgctttcgccacatcgccctcacgcaatgcctgaacaatcccctgataacgccaacccataatgttgtatgtgctgccgataccgccgtccgcgcccgccagcagaccggaagcgaagatttcgtcataaccgttgtacagcaccagatccggatgcgcgcggcggatctgctccatctggaagagatcgccggaggtttgcttcagcgcgttcacgcccggtaatgtcaccagcgtattgatctgatcgagggtaagttttacgccgcttaacgccggaatgttgtataccaccatcggcaatccatctgcggaatcaatgattgcccgataatggtcacagtgctcttcaaaactgaaagggtaataaaaaggcgtcaccgcagagaccgcatcaaaaccgtaacgctttgcggcgctggcaagctgctggctttctgcggtgcttactgtcccgacatgggcgatcaacgtgatttttcccttcgcctcttcggcgacaatctccagtacctgctctctttcagcaaggctctgtacgaatgcttccccggtggaaccgccaacgtacagcccgtcgataccctgcccgatgttaaaacgcaccagacggcgcaggctttcgctatccagttgctgctgatgatcaaatggggtcaacaacgccgccattacgccttgcaatgcttttgccatacctacctctacggatgatgaatatattaactacctacctttatacctgttataccagatcaaataagcagcaaataatacagaacgcttatagtgcgatctgcttcactaaaccgggatcggaggtgcgatcgctaccgcattttttgactttttttaccgagcgcgtgccaggtagcggaaacgctattgaggtgggtttgcagagcgcgatccgctttatcgggatctcgctggcgaatggcatcaacaatcacaatatgctgttgataactcacgttattatgttcatgcagctcacgatcgggaacgcttgggcgagcagcgattagccagtccagcagagcaacatgaatagccataaagatcggattgccgggaatttcagccagcacccggtgaaactcgacatccgaacgaataaacagcgcgttgtcatccagcgactggctattaatttccagcgctttcgttaacaacgcgatctgctcgtcggtggcatgttccgccgcatagcgtaccaggctggattcaaagaaaagccgtagctgttcaaagtgagcgatgccgccaggatgagtaagaaaatctttcgccatacccgacagttcgctgatgatggtatcagcagaggggcgcgagacgcgggcgcgttcgccgttattgatttgcaccagacctttacgcttcagcgcagctaacgcttcacgcacggagggacgtcccacattgaagaaggccattaattcacgttcagacggtagctgttctccctcgccaaactcatgacggcggatcatctgctccagctcttcctcaaccatttcagacagttttttacgcgccagcgggcggcggcgcaaactacgcccgagggatgtcggtgaatcttctgcttgcgaatcaaatgcgttcataacgtccattcatgagtggtcggtggcaaataatagcaagcttatcgtaacacagcttcaaaagcagggtgaacccgcgaggagaccaaacaaaacaggcccttcagggcctgttgattattttactacgcgcagcgccggacgtccgccacgcggcggaggcggctcgtcatcaggactactgtcgtcatcgtggtcgggcttatcgccatcaatgacggacatcacggtctcgctttccgcgcctgcggtattgtcatcatcatttaagctgacaacgtcttcatcataggcggcttcaggctcaaacatggtgcctgcgccgttttcacgggcgtaaatcgccagcaccgcagccaaaggcacagaaacctgacggggaacgccgccgaagcgcgcattaaaacgcacttcatcattagacagctccagattacctaccgcccgcggcgcaatattgagaacgatttgcccatcgcgcgcatattccatagggacatgcacgccaggcagcatcacatccaccaccagatgcggggtcaactggttatccagcaaccactcgtagaaagcacgcaacagatagggacgacgcggcgtcaactgtgacaaatccatacaggttaaccccgaccgaggcgcatttcacgttcagcttcggttaaagaagccaggaaagaatcacgttcaaagacgcgggtcatatagcctttcagctctttcgcccctgcgccgctgaattcgatacccaactgcggtaaacgccacaggagaggcgccaggtagcaatcaaccaggctgaattcgtcgctcaggaaatacggtttctgaccaaataccggcgcaatcgccagcagctcttcacgcagttgtttacgcgcagagtcgacctcggaagcagacccgtttacgatgacgttcatcagcgtataccagtctttttcaatacggtgcatgtacagacggctttcaccgcgcgcgaccggataaaccggcatcagcggcggatgggggaaacgctcatccagatattccataatgatgcgagattcccacagggtcagctcacgatccaccagtgtcggaacgctttgattcgggttgaggtcaatcagatcctgaggtggattgtccttttccacatgttcgatctcaaaactaacacccttttcagccaacacaatgcggacctgatggctatagatgtcagtaggaccagaaaacagcgtcattaccgaacgtttgttggcagcgacagccatgaaaacctccaggtatattcagaatttttactgctaccagccacaatgtgaccagccagatgttatgtcacccagggcgaaaaaagccatcattgctcagaaacgagacaaaaaatgaacattccccgctatttgggcagaaaattggatgatagtttaccagattttgtgacctttgtggtgagtcgattctggaattggggaaaaagagacaacaatccgcatttcattgtgacagataaatgcattgcccataaaaaaacccgccaaagcgggttttttcgctaacagttgtctgccgaagcagaaaacaattaacgtttggagaactgcggacgacgacgtgctttacgcaggccgactttcttacgttcaacctgacgagcgtcacgagtaacgaagccagctttacgcagttcgccacgcagggactcgtcgtactccatcagagcgcgggtgataccgtgacggatcgcaccagcctgaccagagataccaccacctttaacagtgatgtacagatccagtttctcaaccatgtcgaccagttccagcggctgacgaactaccatgcgggcagtttcacgaccgaagtactgttccagagaacgttggttgataacgattttaccgttgcccggcttgatgaaaacgcgagctgcggaacttttgcggcgaccagtgccgtagtattgattttcagccattgcctataatcccgattagatgtcaagaacttgcggttgctgtgccgcgtggttgtgctcgttgcccgcgtaaactttcagtttacggaacatagcacgacccagcgggccttttggcagcatgcctttaaccgcgatttcaatcacacgctcaggacggcgggcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaaataaataagttacacgttggtgaacacccaaacgtttaaatagttgaggttcacacgacaaagtccggtaaacctaccccctcggatatgtttggccggcacagagaaagtttgggaaaaaactctcttgtaacgtggggtcgcaggattatagagaagtccaggtcaaagatcgacccctttttgcgatttgccgcgggttttgttcaggcctagttcaccctcggtcggggaggttgcacagatataataccgcataatgccggagcgctacgcttgtccggcttacggcatatgctcccgcttgagatactccgcactctgcatctcttgcaggcgcgacagacagcgctgaaattcaaacttgagtcgctccccctgataaatctcatataacggcgcggcggcgctgaccaccagcttaacgtggcgctcgtaaaactcatccaccagcgcaataaagcggcgcgcttcgttctccatcagcggcgtcatgaccggcacgtcaaacaacagaaccgtgtgaaataaccttgagagcgcaatgtaatcatgctggctgcgagcctcgacgcacagcgtagcgaaagaggccgctaacgtttggttttcaacgcccagggtggataaagggcgatgattgatttccagcgtcggagcatgttctcgtgcggcccccgctaacgccagccacagtttatccatttgccgccgggtttcatcattaagcggcgttagccataaatgggcctgcgtcagcgtccgcagccggtaatcgacgccggcgtccacattcataatgtcgcagtgctgtttaatggcatcgatagccggcaggaagcgggcgcgttgcaaaccgttgcggtagagttcctccggcggaatattggaggtcgcgaccagcgtaatgccgcgtgcaaacagcgctttcattaaaccgcccagcagcatggcgtcggtaatatcggtgacgaaaaactcatcgaaacacagtacgtccgtctcggttttaaaccgatcggcaataatgtctaacggatcgatctgtccctgtagcgcggtaagctcttcatgcacgcgcagcataaaccgatgaaaatgcaggcgcaattttcgctcacccggcaggctgtggtagaagagatccatgagccaggttttgccgcgacccacgcccccccacatatacagcccgcgaaccggtatttgcgcgtccggttcgtttttgcctaataatttccccagtcgcgctatcagaccgccgggtggcgtagccgacgattttttcgcggtgagcgcctgataaagggtttccagacggtcgaccgcctctttctgtacgtcgtcaggctgatgggtgccttcgttgagtgcctgaagataacgcgatgtaggggaaagactttgcataatgttattgttattccttgaaaatcgatgtgccgtcgttcacggctgacgaaaaaaaggccgttctacactacgcgatatgctgtcgggattccacttctacgaaattagcggttatagtggcataatcaggcgcgggcatggagcctggagccaacaccctacggaaacataagacaacgggagatgttcatgacctgggaatatgcgctaattggattagtcgtcggtatcatcattggtgccgtggccatgcgttttggtaatcgtaagttacgtcaacagcaggcattgcagtacgaactggaaaaaaacaaagctgagctggaagagtaccgtgaagagctggttagccactttgcccgcagcgcggaactgctggataccatggcgcatgattaccgccagctgtatcagtatatggcgaaaagctccagcagcctgctgccggaaatgtctgcggagtcgaatccgttccgtaaccgtctggcggagtctgaggcgagcaacgatcaggcgccagtacaaatgccacgtgattattctgaaggcgcgtctggcctgttacgtagcggcgcaaagcgcgattaatcgcacgccgttaagaaatttatcgggcgcatcgcttgcgccctctctctatctttcctgtcccagctattatcattgttaccaggctgaaaattcaataacatcaatctgttttgaattgtctatccgttcattcaaggtacgagagcagcatccatgaaaaaacacacccagctgttaagtgcattagcgttaagtgtcggattaactctttcggcaccgtttccagcccttgcatcgataccaggccaggtgccaggccaggcgacgctgccaagccttgcccctatgctggagaaagtgctgcctgctgtcgtcagcgtaaaagtcgagggaaccgccacccagagccaaaaagtgccggagaagtttaaaaaattctttggcgaggatctgccagaccagccgtcccagccgtttgaaggactcggttcgggggtgattatcgatgccgcgaaaggctatgtattaaccaataatcatgtgattaatcaggcacagaagatcagcattcaactgaatgacggacgcgaattcgacgcgaagctgatcggcggcgacgaccagagcgatatcgctctgttacaaattcagaatcccagcaagttaacgcaaattgccatcgccgattccgacaaactccgcgtcggcgatttcgccgtggcggttggtaatccgtttggccttggacaaaccgccacctccgggattatttcagcgctgggacgcagcggacttaatctggaagggcttgagaactttattcaaaccgatgcctctattaaccgcggcaactccggcggcgcgctgcttaacctgaacggcgagctgatcgggattaataccgcaatcctcgcgccagggggcgggagcatcggcattggctttgctattccttccaatatggcgcagacgctggcgcagcagttgattcagttcggcgaaatcaaacgcggattgctgggaattaaaggcactgaaatgaccgctgatatcgctaaggcattcaaactgaacgttcagcgtggcgcttttgtcagcgaggttttacccaattcaggttcggcgaaggccggggtgaaatccggagacgtgattatcagtcttaacggtaagccgctgaatagctttgccgaactgcgttcacgtatcgccaccaccgaaccgggcacgaaagtgaagctgggcctgctgcgcgatggtaagccgctggaggtggaagtcacgctggattccaatacctcttcttccgccagcgccgaaatgatcgccccggcgttgcaaggcgcgacgttgagcgacggccagctgaaagacgggacgaaaggcgttaaggttgatagcgtcgaaaaaagcagtcctgccgcgcaggccggtttgcaaaaagatgatgttatcatcggcgttaatcgcgatcgcatcagttctatcgccgaaatgcgcaaagtgatggcggcaaaaccgtccatcattgctcttcaggtagtacgcggcaacgagaacatttatctattgctgcgctaatcctgtcttaaaccgggcatcagcctgcgatgtgatgtccggttaactcatggtatgctgctgccgttcccttttttaacgacgcctccatcatgtttgtgaagctcttacgttcggtcgcaataggtttaattgtcggcgctattctgttggccgtcatgccttctttgcgcaaaattaatcctatcgccgtcccgcaattcgacagtaccgatgagacgccagccagttataattttgcggttcgccgcgccgcgcctgccgtcgtcaatgtctataaccgcagtatgaacagtaccgcgcataatcaactggagatccgcacgctgggttccggcgtgatcatggatcaacgcggttatattattaccaacaagcacgtgattaacgatgccgatcagattatcgtcgcgctacaggatggccgcgtctttgaagcgctactggttggctccgattcgcttaccgacctggcggtgctgaagatcaacgccactggcgggctgcctaccatcccgattaatacaaagcgtacaccgcatattggcgacgtcgtactggctatcggcaacccatataatctgggacagaccatcacccaggggatcatcagcgcaacgggtcgtatcggcctgaacccgacggggcgacagaattttctccagaccgacgcctcgattaaccacggtaattccggcggcgcgctggtcaactcgttaggcgaactgatggggatcaacaccctctcttttgataagagtaacgatggcgaaacgccggaaggccttggttttgcgattcccttccagctagccacgaaaattatggataagcttatccgcgacggtcgcgtgattcgcggctatatcggtattggcggacgagaaatcgcgccgctgcacgcgcagcagggtagcggcatggacccgattcagggcattgtcgttaatgaagtaacgccaaacggccccgctgcgcttgccggtattcaggttaatgatttgattatttcggtcaataataaacccgccgtgtccgcgctggagacgatggatcaggtggcggaaattcgcccgggctccgtcattccggtcgtggtaatgcgggatgataagcagctcacgttccaggtgacggtgcaggaatacccggcgtcaaactaaaacgacgcagcttttgcctgcgtcgttcgacggctagtcaataaagactggccctgccggaaaatgcgccaggaaactcgtgaagattagcagagcggggaaactcttttccccgacggcctcttcacgcagcgccttatcgagtgtcaataagccagactcgctcccttcccccagaatgccgcccatccagagcagtcgttgcgcctgttgacgcgcatactgcgatgcgcttttccaggcgaccagatgcagcaacgtttgtaacagcaggacccgagacgcgtgaccatcgcgttgtaatcgcctgaatacgggtaatgcaatactacgcaccgtcgagaaaccgctcgccgcctccccctcaatcggcgataaaccaacagccgcctgtttgacgaaatcgcataaccgattgtgtgttaatggccgctcgcctgcgctcatataccctgcggcgaaacagagtaacccgataccctgagcccaatcggtcgatggcagaatcccctgcggaacattcggtgccgacgtctgtgcggcacaaagcccctcgtcgtaacactgtgcaaaacgttgctcatatattgctgagttgacgccggaccacggcagcaaatgcagcgctggctcaagctcagttatctgattcaccgtctcaacaacataacgcaagatggtttctctggatggcatggatgtaccttgccgaaacgcaaccatttcactcattactgtgtcctcattttgcgggagcataatcactgctcccgattagaattggattacattgccagcacgtacttcagcatcacgcccgccgcaatggccgaaccgataaccccggccacgttcggccccatcgcgtgcatcagcaggaagttctgcgggttcgactccaggcccaccttgttcgacaccctggctgccatcggcactgccgacaccccggctgaacctatcagcgggttgattttgttcttactgcacaggttcagcagcttcgccatcagcaccccggccgccgtcccgataccaaaggcaatcacccccagcagcagaatgcccagcgtctgcggctgcaggaacttatccgcgaccagcttcgcgcccaccgacagcccgaggaaaatggtcacgatattaatcagaccgttctgcaccgtgtcgctcagacgctccaccaccccgctttcacgcatcagattgccgaagcagaacatccccagcagcggcgcggcgtccggcagcagcagggccaccagcagtaacagcaccaccggaaagaggattttttcccgcttactcaccgtgcgcagctgcaccatgcggattttgcgctctttctcgctggtcagcgcgcgcataatcggcggctggattaacggcaccagcgccatatacgagtaggccgccaccgcaatggcccccagcagctccggtgccagcttgcccgacagataaatcgccgtcgggccgtccgcgccgccgataatgccgatggccgccgcctgcggcagggtgaaggcaatcaggccgaagtagttcagcgtcagcgcccccagtacggtggcgaagatgccgaactgtgccgccgcccccagcagcagggtgcgcggattggccagcagcgggccgaagtcggtcatcgcgccgacgcccataaagatgaccagcggcgcgacgccggagccaatcgccactttatagaacagcgccagcacccccggcgtgtagcccatgtccaccgccagattttccatctggttctggactgacggcagggccagcgccagcgcttccttgatggcgtgcacgtccggcgcgcagttgagcttcgcggcaatcaccgccagctgcccggcgtcgtgatgggccagcaggctctccagcgcggtcagcgccatgcccgcttccgggatgttggagagcaggccgccgaagcctatcggcagcagcagtaacggttcgaactttttcgctatcgccagccacagcaacagcaggctgaccagcagcatgatggcctggcccgcgccaaggtgcatcagccccatgccctgaagcagggcgttcagactttccatttcagttctccgttacgccagcgtcatcagggtgtcgcccacggagacggcgtccccggacttcaccgcgataccgcggacggtgccggcctgcgcggcgcggatttcggtttccatcttcatggcttccagaatcagcagcacgtcgccttcggccacgctctggccttcggtggcaatcaccttccagatgttgcccgccagcggcgcggtgaccggggtgccggcgcctgccggggcggcagcctgaaccggtgcggaagaggccgccggaacagccgtagtaagctggctgatatcgccgccgtcgctgaccctcaccacaaaggctttgccttccacttccacggtgtagataccggaggcggcaggcttctctgcttttgccaccggctgcgcggcttccgcctgcggcagtggctcaaacgccgccgggttatggcggttctcaaggaatttgaggccgatttgcgggaacagcgccacggtgagcacgtcgtcgatggcgtttcccgccagagtaatccccttctcctgcgcctggcgcctgacgtccgcttccagttcagccagctccggcttcagcaggtccgccgggcggcaggtcaccggagcgctcccttccagcacgcgggcctgtaacgcggcgttaaccggcaccggggtgtggccgtattcgcctttcagaatgccggcggtttccttcgcgatggttttgtagcgttcgccggtcaggacgttgagcaccgcctgggtgccgacaatctgcgaggtcggggtgaccagcgggataaagccgaggtcctcgcgcacgcgggggattttcgccagcacctggtccagcctgtccgccgcgttctgctgcttcagctggctttcgaggttggtcagcatcccgcccggtacctgcgccaccagaatacggctgtcgtagcctttcagctggccttcaaaggcatggtactttttgcgcacctcgcggaagtacgcggcgatattttccagcttcaggatatccagcccggtgtcgtgctcagtacctgccaacgtcgccaccagcgcctcggtggccgggtggccgtaggtggcgctcatggacgaaatcgccgtgtccacgccgtcaacatccgcctcgatagccttcagcagggccatctccgccatcccggtggtggcgtgacagtgcaggtgcaggcgcacctcaaaacgttttttgatttcgctcaccagctcaaaagcggccatcggcgtgagaatgccggacatatccttgatggcaatcgagtcaacgccggtctctaacaactgttcggtcaggtccagccaggtctgcagggtgtgcgccgggctggtggtgtaggagagcgtcccctgggcgtgcgcgccgtggctgcgcaccgcctgcagggcggctttcatattgcgcgggtcgttcatggcatcgaagacgcggaacacatccatgccgtttttcaccgcgcgttcaacgaagcgctccaccacatcatcggcgtagtggcggtagccgagcaggttctggccgcgcagcagcatctgcagcggggttttgggcatggcttttttgagttcgcgcaggcgcagccacgggtcttcgccgagaaaacgaatacaggcgtcaaaggtggcgccgccccagcactccagcgagccgtagcccacgtcgtcgagctgagcggcaatcggcagcatatcgtcaaggcgcaggcgggtggcgaacagagactggtgggcgtcacgcaggacgacgtcggtaatggcaatagtcatggatccctccgggaattaagcgttaaggcggtgatggtgaatggcggcggcaatcaccggctttaagcgggtgaagtcgtccacggcgggaacggcgcgcggtgcgggcgcggcgacgggttccgggaagaagcgagtaatcacggcagacataccgcgaatggcaaagatcagcaggaacagaaacgccagcacgaatcccatgccgaggagcatcagagtgaagccttcacctaatagcagagctgcattagtcataaaatagccttcaggcaggaggcacgataatggggctatttatgacgatgaaataataagggtggatttccctgagccgccccggccagagcccttggttattattatcgtcataacgtattaccaccattatcgtgcaatttacgtaatcaggtttatttgatgaaacttacgttctggcatatttcatcagcgacgatctctttacgctgattaaaaataattttgttctgttcaaacagattattcccatgggtatcaatagaaacaatcagcgggccaaactctttaacccgacagacccacagcgtttccggcatccccagatcgcgccattgggcatcttcaatttcttccacgcacacggcggctacaaccgcacaaccggcagggaatacgcagtgcagcgctttgtgttcagcacagccctcttcggtacctttacccataccgcctttacctacaattaatttcacgccagtctgcgcaataaactctttttcgaatttctccatacgcatgctggtggttgggccaacggagaccatttcaaacttatcgtcttcgcctttaattgggcggacaatggggccagcgtgtaaaatagcgccgccgcgaacatctaccggaagttcgcgaccaccttcaattaaacggcgatgggctacgtcacggcaggtaacaatatgaccgttgagataaataatatcgccagccttaatatccgctaaatcttcatctttaattggcgtagtcaggatttttttagtcatcagaaattcactccgctgtgagacgtaatggtgtaattcaaatctttatcgaaaacgatgtgccctttacggtgcgaccagcagccgacgtttaccgccacgccgatggtagaaggatgacgtgcggtgttttcaatgttcacgcccataacggaggtattaccggacatcccctgcggccccaggccaattttgttaatgccgtcttccagcattttttccagcgaggctgcacgctcattctcgttatgcgaaccgatcggacgcatcagcgcttttttcgatagcagtgccgccgtttcaacagaggtcgctacgcccacgccaaccagcagcggcggacaagcgttgaggccgtagctggtcatcacatccagtacaaagcgggtcacaccttcatagcctgcacccggcatcagcaccatcgctttccccggcagagaacaaccaccgcccgccatataggtataaatgctgcactgatcggaattgggaacgatttcccagaagaccgtcggcgtacctttacccacgtttttaccggtgttgtattcatcaaaagtttctacgctgttgtggcgcagcggagaatctacagttgctttgatcaccgcctcacgcaacaacgcttccagctcgccaatcagcggaaagttcgtcccgcactccaccaaaaactgaatgacaccggtgtcctggcaggaaggtcgatccagctctttcgccagacgctggttctcaatcatggtagtaaagatgacgtcggccagtttactggtctctttcttatgcaaatcttccagttttgcagtgacatcatcaggcaaaactttgccggtatatcccacaaacttggccataacgtcggtcatatgggatatctgttcacttttgctcataaatgctccttagtcagaacagcttccgttaattacggatgaaaagggaaaaggattggcagcaggatcaagctgacaatggttgaaacgataatcagggggataccggccttagcgtagtcgacaaatttatagccacccgcggagagcaccatcatgttggcaggcataccgataggagttgcgtaggcgcaggaaccgccaatgaccgtcgccatcagaaccgcacgcgggtcggcccccatacctgcggcaatggacaaactcaccggcaccaatagcgctgtcgttgcggtattggacataaagttggtcatcacaacggataaggcgaaaacggcgatcagcaacatgaacggtgaggagttttgccccagcatgccgattacatagtccgcaaccagcttgcctgccccggtcatttccagcgcttttgccagcgccagggtgccgccaaagataaaaatagtctgtgaatcaatggctttataggcctgtttttccgtgagtacgccgcttacgaccagcacaagagcgccaatacaaccggtcacggccaggctgacaccgatcttcttctcaaagatcatgccgaggatcgttgcgatcaacaccacgagtgagagccgttgtttccactgtggaacatggctgtagtcacgttgctccccgacgctccccacctcaccgccggtcgcattattcggcagaaagcgatagccaatagtcaggaagtagagaatgccgcagatgagcatcgggagaccgatttttgcgtattcaaaaaagccaaagccgccgccaatattctgtagcgcagactgcgcgataagatttcccggcgcgccaattaacgacaggttaccgcccaacgcagcggcgaaaaccagcggcatcagtagacgagaacgcgagaagcccgattttgccgccacgccgatcaccaccggaatcaaaaccgcagcggtaccggtgttagagaggacgccagacatcaaacccaccaccaccataatggtgaagatcagctgtttttctgttttcgcgaagcgcgtgatgacgccgcccactttgtttgccataccggtctcaaacaacgcaccgcccacgataaacatcgcgacaaagaggatgacgttagtgtcgataaagccagcaaaggcctgtttaatattcagaacgccggtgataactaaggccacgcagacaatcatggaagtgacggccagcggcactttttcccatacaaacatgacgatagcgaacaccaataaacatagggtaagggtaatgggttccatatttataattatccaatcaatgatatatgatattgtatccaatattgacgaggagaaattattcccatacaaaaaataagtcaaatcgtttctcaggaaagatgcaggagtgggatctacatcaagatcgtagttggatcgttactggacgtgattaatagaattgaagaattggttgaagcgcctgcgatactcacgcaggcgaaaagatcaggcagaagggtcaccaacatagcgggtcagcatattctccattgagcgaataatgtgttcgcgcatgcgctggcgtgccaatgtttcatcatgaagttcaagagcttgcagaatacttttatgttcctgaatggaaatcacggcatactcttcttcggtgaccttatggcccatcgacaggccgttccacatattacagagcaacattttcattttttcgttgccagcaacattccatatttccatatgaaatgcctgattcaggtcggagtattccgccgagttattttccgcgagagccttttcagcggcataatgcacctcggctatccgcgaaatatcggtgccaggacgagaagctttagccaccgcctcactttctaacagcgcgcgaatttcatagtgttcacggatcgtttgttcattgatgcccaacaccaccgcccctttattagggcgcacttttatcagcccatccgccgccagaatctgaaacgcctcgcgcactggcatactggacacgccgaccattccggcaatgccttctaacgtaatctcttgcccttccactaactccctcgaaagaatcgctttacgcagcaccgccgcgacctgttctttcgctgaaagaagcttaatcttccctaacttaggcctctgcactttcccaatccttcatatgttgacgcattatttctgctaaagagaggaaataacgctgcataacttgcccaatctcatcacgccgcccctggcgtatgacgtcagccagttcagcgaaaagctgcgccgactcctgattatcttttttcagatgcaaaataacataagagacataaccgtccaggaactgctgatacaccttttccagatagcggttattcacataagaaatcagcatcgcatgacactccagttcgcaggatttgtcttctgcgacagccagcgcttgcgcacgtatcaggagggcatcgcctacttcgctgggtatcagcgaaaacatttcggcggccatcgcggcaatcacgcgaaaaatatgactcacgcgatcggcctcaagatgcgcgacctgcatgtgcctgttgggcagtcggattaaaaaaccttcctgttcgagtgactgtagcgcttctcgaaccggcattcgtgaaagaccgagctgctccgcaatactttcctgcgcgagttcttctcccgcttttatattgccggaaagaatttcatagcgaagcatttgcgtaatgtgatcgcgggtttgcgttctttggatctttttcacgacgttctcgttaataaccgataagacgtgaggagtttagcagatttagtgcttgatttcgtggcttgtttatagttaaagaagccggagcaaaagccccggcatcgggcaggaacagcttatttattaataaaatcttcacccaactgaatatcttttttcagcgtatccagcatagcgtccagcgaatgttgctcgaaagtgctcagtgtgccgatggatttacgctcttctacgccgtttttacccagcagcagcggctgagagaagaaacgggcatactgaccgtcgccttccacataggcgcattccaccacgcctttttcgccctgcagagcgcgaaccagagaaagaccgaaacgcgcggcagcctggcccatagagagggttgccgatccgccgccggctttcgcctcgacgacttcagtaccggcgttctgaatacgtttagtcagctcggccgcttcttgttcggtaaaacttacgcctggaatctgcgatagcagcggcagaatcgtcacgccggagtgcccgccaatcaccggaacttcaacttccgttggcagcttacctttcagctctgcgacaaaggtattagagcggatgatatccagcgtggtaacgccaaacagtttgtttttgtcgtatacgcctgcttttttcaacacttccgccgcaatcgcaacggtggtgttcaccgggttggtgataatgcccacgcacgctttcgggcaggttttagcgatctgctgcaccaggtttttcacgatgccggcgttaacgttaaacaggtcggaacggtccatacccggcttacgcgccacacccgcagaaatcagtactacgtcagcgccttcaagcgccggggttgcgtcttcaccggagaaacctttgatttttacagcggtggggatgtggcttaaatcaacggccacaccgggagtcactggagcgatgtcgtacagggagagttctgaacctgaaggcagttggttttttaaaagtaatgccagcgcctgaccgataccaccagcagcgccgaggactgcgactttcatcctaaactccttattatatgattagctaagtgtctattgctccgcggcggcgaccttaattcacaaattcaatgattacaatcctcactcatcaagaatgcggagtcgcgcaattttggcttttatgcatttaatttgcgtaatccggatcggctgcaaccagagagcaacgttctacaggtggtgacaatataccctactaccctctcaaaacaacatcattttgataacaattaatttacttttaatcttatttgcgaggcgtgacacaggcatgtttcttgattacgaaatttgataaaattccgctctttcataacattatttcagccttaaacaaggcagactgtttgcataaaaattcatctgtatgcacaataatgttgtttctaccgccatattacgggtgacttatgcgaagctcggctaaacaagaagaactagtaagagcgtttaaagcgctcctcaaagaagaaaaattcagctcacagggcgaaatcgtcctcgcgttgcaggatcagggctttgaaaatatcaatcagtccaaggtctcgcgcatgttgactaagttcggcgcagtgcgtacacgtaacgcaaaaatggaaatggtgtactgtcttccggctgaactgggcgtcccaacaacatccagtccgttgaaaaatctggtgctggatatcgactataacgatgctgtcgtggtgattcataccagccccggcgcggcacaactcattgcgcgcctgctggattcactggggaaagcagaaggtattctcggcacgattgccggcgacgatactatcttcactacgcctgccagcggcttttccgtaagagatctgtacgaagccattctggaactttttgaacaagagctttagtcccacttcctccgtcgtcgtacggcggaggcatctttttgccctctcccctcgccgctttcctgtacggctatcatttggcaaatcatgcccttaaacattcaccacatgaatgaaaaatcaaaaaaacgcacaaaatgtcaatttttttaaccagttgattttcttttatttttcaaacgacagcggcgaaaaacagcaattttaattccataacgttataaaaaataaaatttttaatgtctttaaaaagcagaaacaattagcgtggtattaattaattgcgtgattagtgtatacttaattttgtgatgagggtcacgaaacaaagaccccagtaaaggaattcgacgaggtaaaaatcatgaaaatcaaaaccactgttgcaacattaagcattctgtccgttctctcttttggcgctttcgccgcagaacctatcagcgcagagcaagcgcaaaaccgtgaagcaatcggatcggtttcagtcagcgctatcggctcatcgcctatggatatgaatgccatgctgagcaaaaaagcagatgaacaaggcgctacggcctaccacattaccgaagcgcgtagcggcagcaactggcacgccactgccgaactgtacaaataaaattcacctgccatcgcatataacgtgtcgttacttcgcggagatatcgcataagaaaagcccattaatccgcgaggttgaccctataaaggaataaaagaccatgaaaacgaaatacattatcgcatcactcggcctggccactctgctctctttcggcgcaaatgccgcagtacaccaggttaacgcggaacaggcgcagaatctgcaaccgatgggcaccatttccgtctcgcagattggcagtacgccaatggatatgcgccaggagatcgtcgctaaagccgaaaaagcaggcgctaatagctatcgcatcatcgaattaaaagaaggtgataactggcacgccaccgccgagttgtataagtaaaccttcgtcgtctaacccgacgacttgcccccgcatgccgggggcttttttatgctttttcaatgccggacattaaaccgtagccgtccctccagctcttcttccgcttcatcaaagagtaaaatcagcgccccgtagcgcctgcgcagtttatcaggcaggtgaacgaactcaatctctagcggtaggggtaagatatcgctcattaccgcatcccataatgtatcaagatcgcttactttctcactggcaaggccaaacgtctgcgtaaactcgcgataaaaatcgctttggtttttaatatcattaaaatcaaatgtatagacattcatagccagccaccatccccgacagacaattgtctgttttactactaagcatcattatgcagaggtttcacttccagaaacgcttttagccccggagcactcttgcgctgtttttgtatctcaaataagtatagtcataaaaaaaccgacgcttttggcatcggttcttgtggattagctatcggtaagcgcgttctggtatttatgtaacatgcccgtcaggcgtttaaccggttccgtcacctgcggcggcgcctcccagatacgtaatttctcctgatagatatccagctcatccagcaactgaccaaagtagcgtcgccgtttatcatcgcttccggcggaaataacatggtctgcggtacgacgaagctggcggtggaacactgacagatcttcattaaccggtatcggcgcgtcgcgcagacgttgatgagcaatgatcatcgttagcgccaggcggaacttcggcaaatcgcctgggaatttattcatcagcaaaaagagttgctgatataacgcaggcagacggttttctttacggcgtaccacgttggtcgtcattgccgagaccgcagcggaaacaaactgattaagcagcacgcgaccggttcgatctttggatttatcacgcaccagcaggatgacgataaacgccagcatacagccgacaatttgccccaacgcgctgtcgaggaactggatgaaatggaacgtcatcggattatccaacacaataatgttaatcgtactggccagcgcccccatcgaccccagacgccgtttctgaacttcaataccgataaagaaccccaataccgccaggctcaaacataacaacagcatactttgctgcgtattgggaataatcaccaggaaatagagcaatcccagcggcaacgccgccagagtgccataaataaaatcaatgcagaccatgcgcggattgggtaaacgcatcgccagcgaggtcaccacggcaatcatcaccatcgcgccattacccgatgtccagccggtccatagccagaataatgtccccagaatgcaggaaagcgtggtgcgccagaagttcaccatcgcatggtggcgttcagcggattccactttaactacgggctcgccttgcaggatctcttcttccgtcgcgctgattttggtgttactgatcacgccgcgtttaagcaacagatagcgcgttgcagcgcctacccagctataaagcgtgacgggcgtttcgcgctcgccggtccaaacaatgacacgccgcatccgttttaactgcctgtggacgtcctgtaccgtttcaaccggcgtctcgaacagttcccggaatgtatcggtaatcagttccggccgcgtgttttgaataagataagtttcacaggattgcgtaatcagcgtgagcgaaagcgtattcaacgctttcaggcggcggttagcgcgtacccagcgcgaagattccatattcagattacttcgcatcccctccagcgccgccgtgcgtcgcaccagatcgccccaggcgttgtcgacttcttcgctgtcgccatgcttaatacaaagttgcattagctgatattgcgctaccaataaacagtccagttcgcgatcaacctcctgctttatcgatcgcggcgagaaaagcagatccgctaaaatagcgcagccaatgccgatgacgatttcgctacagcgctcaagcgcaaattgcggcgtaagcagcggctccgtctgaatggtaatcacaatgatcagcgcagtataacctgacagtccccacgcataagagttttcgatccgtactaaagaggagatccaggtacaaaaaccggcccagacacagcacaccagaatcatcaatagcggcgcgcggatcatagagataataatgataagcgcggcgatacagccaataaacgtcccgataatacgcaacattccgcgataacggatagcgccggaatagggttccccgccggcggcaaatgccgggcctgccgccacgatcgcggcggtcagcaccgcccaacgcggcgtctccagctgaaaatggaagccgataaataatgccagcacaatggcgcacgccagctttaccgcaaaacgaatgtgctggttggcaatggagaaaatgcccatgacgattaaccgaattcgcgcagccggtgcgccagtttacggaagaaggagtcctggcttgcgtcacgatcctgcttaccggtgatcacgacggttgccgtcgtaccggcaggccacaaattcccctgctgctcgtcgagccggatgcgcaccgggacacgctgggccagacgcacccattcgaggttagagtctatcgtcgccatccctttcgcatcgctggtactgctggcattcgttacccctgccgccacgctatcgacggtgccttttaatacccggttgctgccgagcggcgtgatttcggcacgatatcccggacgcacgccttccagcttggtctcttccatataggcctgcacgtaaaaagagttctttttcaccagggcgacggctgtggaaccgcgggtaataaattcaccggcataaacattgaggttagttacccagccgtctgcaggcgcacgaatgacggtacgctccagatcgagtttagccagatcgcgcgtcgcctgggctttagccaattgatgcagtaccgtctgcaagacgttgttcgcctgatcgatctcttcccgggacatcgcctgtacgccgaggcgattacggcgaccggcttcctggcgtttttcctgcgccagtacctgataataggctacatcagcttccgcttccgccagcgctttttgatagcgtggctgatcgatggtaaacaggacctgatcctttttcaccagttggttatcatgcacgtttacatgggtaatcaggcccgcgacatccggggcaatagcgacgacatcggcgctaaaacgcgcgtcgcgcgtccagggtgattcggtgtaatacacccaggcgcggaaaatggcgataaaggccagaataaccagtacgagggtaatggccgtacgggagagttttcttgttagtgttttcacttcaacctcaaacgaacaggcgcgatattaaataaaacagacaacaatacagcgcggtattgaacagagccggatgccagacaaaatcatagatgcccgtcggcacaagcatccgacgcaccagccaaaaaatagccagtgacaaaagcaattcgaaaaatatcggtgggaaggaaagaccaaacaccacgataacgggaaacagactcatgttgaccttgatttctgagagagagcaggcgatagattgttaagctacatcgccgcagagaagggcaagagacgccaggcgagagcgacatagctcttattcgaataatagtatattaacgtaattgttatgctgttatctatattatgtgatctaaatcacttttaagccagagtgaataatggaacgattaaaacgaatgtcggtattcgccaaagttgttgagtttggctcttttaccgccgcagccagacagctgcaaatgagcgtatcgtccatcagccagactgtggcgaaactggaagatgagcttcaggttaaattgctcaaccgcagcacacgcagcattgggctcaccgaagctggaaaaatctattatcagggctgtcgtcgtatgctgcatgaagtgcaggatgttcacgagcagctttacgcttttaataacacgcctatcggtacattgcgtatcggctgttcttcaaccatggcgcaaaatgtgctggccgggcttaccgcaaaattattaaaagagtatcccggtctggcggtcaatctggtgacaggaattccggccccggatttaattgccgacgggctggacgtggtgatccgcgtgggcgcgctgcaagactccagcctgttttcccgtcgactcggcgcgatgccgatggttgtgtgcgccgccaagccctacctcgctcagtacggcgtcccggaaaaacccgccgatctcagtagccattcctggctggaatatagcgtgcgcccggataatgagtttgaacttattgcgccggaaggaatttctacccgactgattccacaggggcggttcgtcactaacgatccgatgacgctggtacgctggctgaccgccggaaccggaatcgcctatgtgccgctgatgtgggtgatcgatgagatcaatcgtggcgatctggagatcctgctgcctcgctatcagtccgatccccgtccggtgtacgcgctgtacaccgaaaaagataagctgccgcttaaagtgcaggtagtgattaacgcgttaactgactattttgtcgatgtcgcacacctgtttcaggggatgcacgggcgagggaaagaaaaataaaaacaccgggtaattgctgaagacgattgtagatcagatgccacccgaggcagacattgcctgatggcgctgcgcttatcaggcctgggcggcacataccacaggcctgataaggcggacagttatgcggtgccgccaaccgtcaggttatcgactttcagcgtcggctggcctacgcctaccggcaggctttggccctctttaccgcagacccccaccccgttatccagcttaaggtcgttgccgaccatggagatctgttgcatcgtttcaatgcctgatccaatcaacgtcgcgcccttcaccggcgtcgtgactttgccgttttcaatcagatacgcttccgaggtagagaacacaaacttgccggaggtgatatccacctgaccgccgccaaagttaggcgcatagatgccatactcaacggattcgataatttcctgcggcgttgactgccccgccaacatataagtattcgtcatacgcggcatcggcagatgcgcataagattcgcgacgcccgttaccggtcggcgcagcgcccatcaggcgcgcgttcagcttgtcctgcatgtatcctttcagcacgccattttcaatcaatacgttgtactggcctggcgtaccttcatcatcgatagcaacggagccacgacggttcatcattgtgccgtcatccactacggtgcaaagcgcggaggcaacctgctcaccgatctgaccgctaaacacagacgtcccacgacggttgaaatcaccttccagcccgtgcccgaccgcttcgtgcagcaatacgcccggccacccggcgcccagaaccaccggtaacgtccccgctggcgcagcgaccgcggagagattaaccagcgccatgcgtaccgcttctttcgcccacgcgtcggcgcgcacctcgccgtcaagatcggcaagaaaatactcataaccaaagcgaccgccgccgccgctggcgccgcgctcgcgtttaccgtcttcttccacctgcacgctaacggacaaacgcaccagtggacggacatccgccgccagcgtcccgtcggtcgccgccacgaggattaattcatatacgccggtcaggctggcgttaacttcctgcacgcgtttatcggcttctcgcgccgctttatcaacgcgtctgaggatatccagcttctcttcgcggctcatactttgcagcggatcaagggtggtgtagagcggctgatgcgctacggcggcgagcgtttttaccttgccttcgccgttctcgcgtacaatggttcgcgctgcctgcgcactctgctccagcgcaaggaggcttatctggtcagcataagcaaaaccggttttttcgccgctaatggcgcgaacgccaacgccctggtcgatattatatgaaccatctttaatgatgcggtcttctaaaacccaggattcgtgatagctcgactgaaaatagaggtcgccataatcaagacggcgttcggccagttggcccaaaatagcgaacagatcctgatggttcaggccattcgccgctagcaattgttcacttaccaggttcagactcatcgtttttgctactcgttgatttctgccggatggcggttcacgccttatccggactacgttgttagattgtgcaaaccggataaacgcagcgccgtccggcatgactatttactgagagtggggcaattcctcgcccccgtcaaatcattgctggctttcttttctcggttggcgcagaacttcgttgatctgcggcgcatcgaccggaccggtaatgcgataacgcagaatggagaccttgctccatagcggccccaacactttactggcggcaaataccgccgcgccgacaatcgggttaacggcaaacgcggcagcgacgcccacggtggcggaaatttccgccgcgacaacggcctccatatcaagacgacgacgcaccagatcaacagaacctttcattgcaatatccgcttccagcccatccaccagcgtatcgtcagtatgcaggacgccatctttaatccacgcggtactatgaatagagtcgaaatagaagccctcgctaaaggtatctctgaagtcaaaccgcagcttacgcagcaacgcatcaaaactgagcagccgcagtagctgtccggcatgaccgctactgagatcagtaaactcgcctttgcccagacgcgtacgtaaaatcccgttgagcgtggcttcctcaggttgccagggcgggtttcgccagtgcagatcgtaatctacgttaaaagacgcgttctggattggcgtcgagatgccgaagaacccggcagccgtgtcgaggttactaccatgcagactacctttcagcgaggttcgttcattacccggcgcattcacccactcgccgttcgctttcaaacgggcgaatccggtatcgatcaggccattcgccagagtcagcgtattgcctttgatggcgaaatcgccatcaatacgcccatatttttgcccccatagccagcactcttcgcagcgaagctgtaagtccggccagccgcggaagctaatcgtgttcgccgaagccaacggcgatgtcggcgttggtgacgaggcgtgcgtttttgcgacgccagggttgtagtacaggtacttaatgttcgccagccacggcgcatggttgcgcatgagtagcgtggcgttcacctcacggccctgcgcttcaatttttgttccgttcagcgagggggctgaaacgacgctcaaattgttccactgctggccgcccagcgatagcgcgggagtacgcaacgtgacgcgttgaggaaactcggccgaactgctcacgttatccgccgcgcctttctggaataacgccagccattgcgcgccatccagcgccggcagattgagctcaacgccttgttgagcaggtaatggcggaatcgtccggctgtccgtcgtccagatagcccgatccaacgtcagcttctgatttaataaccagcggctgttaaagtgatttttactccctgcgctccccgttagcgcaaaacttttcaggttgccgtcagcctgaatgttcaccggaatggcttcgcctgcgggtttatttagcggagaaggtaagtgactgctcacatttctcagatcgccgttcagctcgatgtgataagtggtgtcagcgtgatatggaagatcgatgccgactttaccattccacgtcacgctgccgctcagggcgtcattcagttgcggcggtaagacgcccatacgcgttggctgccagttaccgttcaggttgacggcgacctgataggcttttgccccttccgtcgtactgaaatccaggttaagcggctgattaaaccagtttgccgtcagtggcccgctttttagcgcgccattcacaaagctgaatttaccgttcagatttttgagcgtgctgtttagcggcttaataaacagactgttattacgcaacgagacatcgccctcggcggtaacctgttctccgtccagcggaatatcaagatgtaagcgagcattcacatcgccatctaattggagctccgccagcgtcgagccaagcgagtcttttagcggcgtctcgtcaaaataaggcccaacggcttttcccggcccgttaatatcggcatcaatgagcagtttctctttggaataatccggaatcgccgccgcgagtttgctggccttcaccccgcccaaatcgacgctatccgaacgcatccacaggccgtcgttcaggaaatccagttcaatgttgagattttttagcgccggccagtcgggttgaaaagcaaacgtcgcattgcgtagcggcaccagcacttcaaactgaccttcgttatgcttatagggaaagaggtgcgggttaccaccgtaaaccaacgtggcgttatccgcctcgccgccctgaatcgcgccgctaaggtaatcgactagcgctttgcccatcaggttttccggaaaatagcgccacgcctgagatccatcatcggtactgattccggccagaatacccagccacggttcgtcgcccgtcggttgcagatagcggaacccgccgcgcgcatgtaccgcctttgctttgacgtcaatgtcgcggccatcaagctgaaagccgttctcattcttcaaccagctaagcgtcgcgacgccgttttcaatttccagcggcgcgcgaaaaacggtttcatagggcatcttagcctgctgcatcgcaaccttcatctgcccgtcttctacgcttcccgccagcgtaccggaaaaatgttccgcgccgggcaacagcttccactgtttccaggcaagattttcccacgatgcctgaaaacgcgttttttcggtcgcctgtagcggaatatccagcgccagtgtggcgatctttccgctcggctgcgtagcctgccatatttcgcccagcacaggcgacagtttagccgccagcggacgtaatgcttccagccccgccagttcaagattactggcgcgaatgcgtagctcatcgctacgtgtgtgattctcgccgccgacgtcctgctgcgggagccaggccacggttaaggctccgctcggccagggtttgccatcaagcgtaatccgtgtgtccggaatataaaactgccagcccggctgctcgcggctaatctgcgccgtcaggttatcgacagacaacgtatgcgtcgtgttatcgcccagccagcttgcgccgccctgtttcagccagacgtcccctccggcgatttcgcctttactgagcgtcatccagccttccagactgaaacgcgccgtctggagcgccacattatcctgcatccatttgcccagccacggcttgacgtcaatatcgtcggcctgtaaccagactctgccgttatttagcagaccgtcgtcatcgcgtaaatccatccgcacctgcatcacgccgtgctgcccggtcaggctggagaggctgacctcgccttcggctcggtgccgctctttgccgtttagccaggtaagttgtgggatcgccagttccgcgcgttgtcctgaaagcgtcagaaaactgatttggctatcgcgcagatcgaaatgatcgaactgccgcaggaaaagatcgcttaaacggctggtttcgatgccttcgccgtcgctgctttgaagaggcgtgttggtgcggaaattgagttgccagaaggtcaggtcgcgaaactgccagcgcatgtgcaacaggctttgccagacgtccagcgccagcgtaacgcgttttatcgacagctcgccgccatctttcagggcggcatgaatattatgcgcttccagcgtagggccaaaattttgccagcttgcggagagttggctggcggccaccggcacgccggtcacggactcaattttattcaggatagctggacgccaggcgtcaagatgaggcaacgccaggcgcagcccgctaaccagcagcgctgcaatgacgatgagcgcggctccagtgagcaataaaatccccggcaatcgcctcacgcgtctctccttgtctgccaaaaaatacgactcaccccccttgagggtatattgccggatggcggcgcttgcgccttatccggcctacatgcgctggtgctattactcaattacatcattacgacgtcaaactgctcctggttataaagcggttcgacctgaactttaacctgtttgccgacaaagatttcgacttccgccagcgcgtgtgattcttcgcctttcagcgcttccgccaccgcaggagaagcataaaccaggaagcgatcggagtcataagcgtgatgaacacgtacaatttcacgcatgatctcatagcagacggtttccaccgtttttaccgtcccgcggccatgacaggttggacactcgttacaaagcacatgttccacgctttcacgggtccgtttacgggtcatttccaccagtcccagcggcgaaaaaccgttaatactggttttcacgcgatccttacttaacgcctgttccagcgaatgcagcacccggcggcgatgatcttcattattcatgtcgataaaatcgataatgataatgccgcccagattacgcaggcgtagctggcgggcaatggcctgcgtcgcttcaatattggtattaaaaatggtgtcgtcgagattacggtgtccgacaaacgcgccggtattgatatctaccgtcgtcatcgcttcggtttggtcgataatcagataaccgccagacttgagttcaactttacgctccagcgcgcgctggatttcattttccacgtcataaagatcgaagatcggctgatggccactgtaatgctccagcttactggtcatttccgggatgtattctgcggtaaactccagcagcgactcataggtcagacgtgagtcgacgcgaattcggtccaactgcgcatcggcgaaatcgcgcagcacgcgctgcgccagcgccagttcgccatacatctggtagcgcgtttgcggacgctttttgcgctccatgactttcgtccagacgcgcttgagataggcggcgtcagacgcgagatcctcttcacacacgccttccgccgcggtacggataataaacccgccctgttcgtcgcagtattccgccaccacctttttcaggcgctcgcgttcactttcgctttcgatgcgctgggaaacgccaacgtgtgacgcgccgggcataaaaacaaggtaacgggagggcaacgtgatgtccgtggtcaaacgcgcgcctttcgtgccgagcggatctttcactacctgcaccatcagatcctgtccctgacgcaccagttcggagatatcgcgcacggtaaactgtttttgctcgtcgcccgccacgcattcggtatgcggcataatgtcggaagcgtgaagaaatgcggctttatccagcccaatatctacaaaagccgcctgcatacctggaagtacacgacttacacgacctttgtagatattgcctacgattccgcgtcgcgcttcgcgctcaatatggatttcctgaagaataccgccatcaatgtacgccacgcgcgtttccgatggcgttacgtttaccaacaattcagccgtcatgtttatcccttttatcacgcagtgcgttaaaatgactcaacaactcatacgtttcaaccagcggtaagccgaccacggcgtgatagctgccatttatcttcctgacaaaacagccaccccgcccctgaataccgtatgcacctgctttatctaaaggctcgccgctggcgacatagccagtaatatcctgcgcagaaagcgtgcggaaagtcacctccgttaccaccagacaatccagcgtctgctgcgagtccgcaagcgcaacagcagtcatcacctgatgcgtatttccggaaagcaaacgcagcatttctgcggcatgagcggcgtcgcgcggcttttccagcacctcgccgtttaacacgactatcgtatccgcgcccaacaccggcagatcacggggaaccagcgccacgccagcctgcgccttttcgcgcgccagccgaacaacatactgctgcgcgctttcctgaacacgccgttgctcttcaataccaggcacgacctgctcgaatgaaaatccaagttgaatcaataattcctggcgacgcggggaaccggaagcaagatacagagttgtcatatcgacctttattgcacagcaaactgctggcgtactttacgcatcagcaaaaagagccagggccacagcacgccattgactacactactccagaacacttccggtctgaaagagacgttgatcactaaaaactcggcccagaaaacaataatgtccacggccagtgaaagcaacattaccaccagcgcctgctgccagagcgccaggttacggaagagctggaatttcagagcgaccagataggcgacaatgctcatcgacagagcgcgcacgccaagtgtggaaccgctgatgagatcaagtatggcacccatcacaaatcccgtccccacatttacgcggtgcggcagggccagaatccagtacagtaagatgagcaaaacccagtttggccggaaaacaatgatgtcgtccggccagggcatgatttgcagcaacagcgcaataagaaacgagagccagataacccagcgcccctggctacgatagctcgccaccattaccctcccggcgcacgcgcagacggcgtggtcgcgcccgaaggcgatgattgcgttgataccggcgtagtctggcccgcagatggctgagtaatccccgtcgccgggtccggcactggcgccggcggccccatcgcatccggagaaggtaacacctgcggcatcatctgcatcaggcgctcattggcgacgcggtgaacctcttccggcgtcatcggattggcgccgttacgatcggctccccacaacagcagcagatagcgtaaacgctgcaaacccgcggttggacgagcctgaatgacggtataggcgcgctgagtgtccagcttgacggaggagaccaccgccaccggatacccttccgggaaacgcccaccaagtccggacgttaccagcacatcgccaacgcgaatatcggtattggcgggcagatgttcaagctgaagatcgtcagtgcagccgttaccggcggcaatcacgcggatgtcattgcgtagtacctgaatcggcagagcatgagtcgcatcgcaaatcagcaatacgcggctggtcagtttcgccacggcgacaacctgccctacgacacctttgtcgctaatgaccggttgaccttcatatacgccattaacgctgcctttatcgataacgacctgatcgctgtaaggatcgttaaccgttgaaataacctgcgtcaccattttctgctcgtcctgacgcagcggcgaccccagcagctcgcgcaaccgcgcgttctcctgtttgtactgccccagcatcagcaggtcgctgttttttagcagtaattcctggcgcagcgcccggttttccagctcaagctggtcgcgagaagccagcgtttgcgacacgctgtcgagcagttcacgagggccgtttgaaataaaatagaaaggactgacggcagtgtccatgtacgttcggatttgactgaacgtccccaggcggctgtcggcaatgataacgccgagcgccaccagcaccgccagaataaggcgaatctgtagcgacgggccacggctaaaaattggcttcataggctatgcgtattctcgcgtcggagaggcaggacaatccagggataatcctgcccgtatccaactactcttcgctgaacaggtcgccgccgtgcatatcgatcatttccagcgccttgccgccgccgcgcgccacacaggtcagcggatcttcagcaaccacgacaggaatgcccgtctcttccattaacagacggtcaaggttacgcagcagcgcgccgccgccggtgagcaccataccgcgctcggagatgtctgacgccagctccggcggacactgttccagcgccaccattaccgcgctgacgataccggtcaacggttcctgcaacgcttccagaatctcgtttgagttcagggtaaagccgcgtggaacgccttccgccaggttacggccacgcacttcgatctcgcggacttcgtcgcccggataagcggaaccgatttcgtgtttaatacgttctgcggtggcttcaccaatcagagaaccgtagttacgacgaacgtaattaatgatggcttcgtcgaagcggtcaccaccaatacggacagaagaagagtaaaccacgccgttcagggagatcacggcaacttcagtggtaccaccaccgatatccacaaccattgaaccggttgcttcagaaactggcagacctgcgccgatcgcggccgccatcggctcttcgatcaaaaagacttcacgggcgcctgcgccctgagcggattcacgaatcgcgcggcgttctacctgcgtcgcgccgaccggcacgcataccagtacgcgcgggcttgggcgcataaagctgttgctgtgcacttgtttaataaagtgctggagcattttttcggtcacaaagaagtcagcgataacgccatctttcatcggacggatcgcagcgatattgcccggcgtacggcccagcatctgcttcgcatcatgaccgactgcagccacgcttttcggcgaaccggcacgatcctgacgaatggccacaacggaaggctcattcaatacgatgccttgtccttttacataaatgagggtattcgcggtacccaggtcaatggacaggtcattggaaaacatgccacgaaattttttcaacatactaagggataatcctgaaagctggggcggaaaacaaaatccgcttactttaccaaccacacgcagcagcgacaaggcgcaaaaatcatctgctacggtgaaaattagtgcagttcgtttcctttgttacaaatctcggcctgagtccctcagggctgaaaaaatcagcagcaatcctcgccttcgtttgcaacctgtcaaaggtcattcacctgcatatttgctgcaacaatctggcgagcagacaagcacacccccatgaggcgcagcgcgcgttattctacgtgaaaacaaattaaacggcaggttaaaccgagtatctttgcgaatattttttcacgtttgtgtcaagtagttgggaggaggcaaaaaaatcaccctgcccgccagccacgccgcgttttgtcagcgtctgccactcgccgcgcgaacggacgcccgtcgcgtaaacctgcgtaggcgtgcccgcgcaggcctctaccagactttgaaccagaagctggttttccgttcgcttctcaatgtttctgaccagactcggatgcagcttgagtaattccacattgagcgctttaatccagctcgtgctaaccagcgtcaaacccgcctgtgtcaccgccacccgaacgccaagcgcattgactaagcgaaggatgggttgtaaccggctgatgtgttgacaaacatctgcctccgcaagttcaataattatgcgatttcgctgtgatttttcacactgcattaacgtatcgcgcaaccagcgctgaaaacgcggacgaatcagcgactcaaccgtcaactgcattgccagattttcatccggccagtagcccagcaacgtaatcaggcggctaatttgtaatctgtcatactcttccgataaaccaaattgcaacaccatcggcatatactccgccgagctcacctcttctttaccgtcatagatgcgacacatcaattcccgatgatgtacgcgaccttctcgcgtgaccgccggtttttgataaagtcgcggtccgccccggttcagcatctgctcaatcaatgtgcgccagcgcacattgccgcgccctttttccggcagagtgtcgtcgtagatagcccagctatttcccccctgcagggcggcattccgcgccgcggcttcagcatgttccatcacctgatcggtggactgtccgctgcgccaggcgcaaatgccgatatgtaccatatcgtcacgatcgagcattttgttagccggtagcgcatcgacagcttttaaaagttgtccggcaatactttccgcttctttcagcgttcgatgcggtagcagcacggcaaagtcgctgcggtgataacgcgccagcagcgagcctgggtaacgcataatgaatgtcgatagcagattgataagcataaacatctgctcttccgcctgattgcctcccaggctgtcgcgcagaagattgaagtctggcaagcggatcatcatcaccacgccatgcactcccactttttcctgatcttccagcagcgtcgccagctggttatcaaagaacagacggttaccgagtccggttttggtgtcctgcgcggcgtaggagcgaatgagggtgtccaggcgactacgctgttcgtgagcaaactgaatttcggaaagcaatacatcaagcgcgctactggtgcgcgctggccattcgtaaacagaaccgcggacattcgccccgcgttcgccgttcagaatacgcgttgagcgaatttccagaagctcctgcccggaaagctgccgctgcagccagcgcaccgataaaaacaaaatcagaacgataaaaccgatcgccagcgtcagcggcgccgtggtgatcagtgagtgaaaataattacccatcgggtcctgataaaccagacgtagcgacattcctggatgttttatcagcggtacgaccagctcgcgatacatgtcgctggtgccggctggccgataacctctggcgcgagaatggctgtagacgctgcgctccccctgcaacagatcgacacgcacaatatcggaagcgatcatgagctcgtcgatttgcggcgtcagcgagacaatatcatgggtcaccaggtgcgtatcaatggctgttgccgtcgcctgcacacggctgacatacttatactgtacggcgttataaaagcttagcgagcaacctatcagagtcacgaagatcgttaatcccgtgagcagcgtgataaaagctgagaatttcgtcgttaatcgcatccttgagttaactccgacggttataaacagtatgaaaaagcgaatctgaaggcggaattcgccacggcgcgcaatgaagcaggcatactaccaaaatggatctatctggcaatttattgcgttgcatcggcatcacgttttaattagcgagtatagtcttcgtagctatttttccaatctaccatgtaaagtgaggacaggttatgcaggcgttgatcttagaacagcaggacggtaaaaccctcgcatccgtgcaacatctcgaagagagtcaactgccggcaggtgatgtgacggtggatgtccactggtccagcctgaattataaagatgctctggctatcaccggaaaagggaaaattatccgtcattttccgatgattcctggtattgatttcgccggcaccgttcacgcaagcgaagatcctcgctttcatgcaggccaggaagtactactgactggctggggcgtgggcgaaaaccactggggcggcctggccgaacgcgcacgcgttaaaggcgactggctggtcgcgctgcctgcgggactgagcagccgtaacgccatgatcatcggcaccgccggttttaccgccatgctgtgcgtcatggcgcttgaagatgcaggtattcgcccgcaagacggtgaggttgtcgtcaccggcgccagcggcggtgtgggcagcactgccgttgcattactgcataagctgggctatcaggttgcagcagtatcaggacgtgaaagcacccacggctatcttaagagcctgggagctaaccgtattctcagccgcgatgagtttgctgaatctcgcccgttggaaaaacagctgtgggccggtgcaattgataccgttggcgataaagtgctggcgaaagtcctggcacagatgaactatggcggttgcgtggccgcctgcggcctggcgggcggcttcgcgctgccgaccaccgttatgccattcattctgcgtaatgtgcgtttgcaaggggtggactcggtgatgaccccaccggcacgtcgcgcagaagcctgggcgcgtttggttaaggatctgccggaatcgttctatgctcaggccgccacagagattacgctggcggatgcgccgaagttcgccgatgccatcatcaataatcaggttcagggccgtacgctggtgaagataaaataacgtcacgtataaaaaaatttacacttaattacctatttatttttacacattgacacactccctattatattcactacacgccatgttgtggtgggtagaccgggagtctgtgatgaaaaagatacgtccattaacagaagccgatgtgactgcggaatcggctttttttatgcagcgccgacaggtgctaaaagcattaggcatcagcgcggccgccttatccttaccctcaacggcgcaggccgatctcttcagttggtttaaaggcaacgatcgtccgaaagcgcctgccggtaaaccgcttgagtttagtcagcctgccgcctggcgaagcgatttagcgttaacgccggaagataaggtgacgggctacaacaatttctatgagtttggccttgataaagccgacccggcggccaatgccggaagtctgaaaaccgaaccgtggacgttgaaaatcagcggggaagtcgcgaaaccatttacgctggattacgacgatttaacacatcgttttccattagaagagcgtatctatcgaatgcgctgcgtcgaagcgtggtccatggtcgtgccgtggattggtttccctttatataagctactcgcgcaggcacagcccaccagccacgctaaatatgtggcattcgaaacactatacgcgccggatgatatgccaggacagaaagatcgctttattggcggcggactgaaatacccttatgtcgaagggctacgtctggacgaagccatgcatccgctgacgctgatgaccgttggcgtctatggtaaagcgttacccccgcaaaacggcgcgcccattcgcctcatcgttccatggaagtatggttttaaaggtattaaatctattgttagcattaaactcacccgcgaacgtccgccaaccacctggaatttgtcggctcccaacgaatatggtttttatgccaatgtgaacccgcatgtggatcatccacgctggtctcaggctaccgaacgctttattggttcaggcggtatccttgatgtgcaaaggcagccgacgctgctgtttaacggctacgccaatgaagtcgcttcgctgtatcgcggtctcaatttgcgggagaatttttaagtgcgtctgacagtaaaacagataacctggctaaaagtttgtctgcatcttgccggttttttgccgcttctgtggctcttttgggcgataaatcacggtggactcagcgcagacccggtaaaggatatccaacactttaccggtagaaccgcgctcaaatttttgctcgccaccttgctggtttcaccgctggcgcgctacgctaaacagccattattgatacgcacacgccgcctgttaggattatggtgtttcgtttgggcgacactgcatttaaccagctatgccttgctggaactggggatacataacctggcgctgttaggaagcgagttgatttcacgcccttatttgacgcttgggatcattagctggctggtgttattggcgctgacgttgacctcaacgcaatttgcgcagcgtaaattgggcaaacgctggcaaacactgcataacgtcgtctatcttgtcgcgatcctggctcccatacattacctgtggtcggtaaagattttatcaccgcaaccggtcatctacgcggcattagcgttagcccttttagcgttgcgttaccggaagtttcgccagtggtggcgctagtttggtgaactgtgcggtcgattgcaaaacgcaaaacaggtaatgtcctttttatgtttcgggttgattatcttccctgataagaccagtatttagctgccaattgcgacgaaatagttataatgtgcgactttacattccccaacggcgattttcgttcgcagataagggtgacaatcgtgcaatgaaggtatattttgttttttgcccgaaaatggcagaagatagccacacaatgactggcaaatcatgaatttcaccttcgggtgctacggcataacaggcaaatcaaagatgcgcggtattttacccgcggcagtcattcacatgctttacagacggcgctaaaacgcctgtcacaatcacactaaacaaagagtacggaacccactcatggatattcgtaagattaaaaaactgatcgagctggttgaagaatcaggtatctccgaactggaaatttctgaaggcgaagaatctgttcgcatcagccgcacaacggcaaacgccggtttcccggtgatgcagcaggcttatgcggcgccgatgatgcagcaacccgctctgtctaacgctgtcgcgccagcggctactccagcaatggaagcgcctgccgcagcggaaatcagtggtcacatcgtacgctccccaatggttggtactttctaccgcaccccaagcccggacgcgaaagcgttcatcgaagtgggccagaaagtgaacgtgggcgataccctgtgcatcgttgaagccatgaaaatgatgaaccagatcgaagcagacaaagcaggcactgtgaaagcgattctggtcgaaagtggtcaaccggtagaatttgacgagccactggtcgtcatcgagtaacgaggcgaacatgttggataaaattgtcatcgccaaccgcggcgagatcgcactacgtattcttcgagcctgtaaagaactcggcatcaagaccgtcgctgtgcactcaagcgcggatcgcgatttaaaacacgtattgctggcggatgagacggtctgtattggcccggcaccgtccgtaaaaagttatctgaacatcccggctatcattagcgccgctgaaatcaccggcgcggtggcaatccacccgggttacggcttcctttctgagaacgccaattttgccgagcaggttgaacgctccggctttatctttatcggcccgaaagcggacaccatccgcctgatgggcgataaagtgtccgcgattaccgcgatgaaaaaagcgggcgtgccgaccgtaccaggatctgacggcccactgggcgacgatatgaatgcgaaccgcgctcatgccaaacgtattggctatccggtgatcatcaaagcgtccggcggcggcggcggccgcggtatgcgcgtggttcgtagcgatgctgaactggcgcagtccatctccatgactaaagcggaagcgaaagcagctttcagcaacgacatggtatacatggaaaaatacctggaaaatccacgccacatcgaaattcaggtgctggcggacggccagggcaacgctatctatctggcggaacgcgactgctccatgcagcgtcgccaccagaaagtggttgaagaagccccggcgccaggcattacgccggaactgcgtcgctatatcggcgaacgctgcgcgaaagcgtgcgtagacatcggctatcgcggcgcaggaacgttcgaattcctgttcgaaaacggcgagttctatttcatcgaaatgaacacccgtattcaggttgaacacccggtaactgaaatgattaccggcgtcgatttgatcaaagagcagttgcgcatcgcggcgggtcagccactgtcgatcacacaggacgaagttgtcgttcgaggccatgcggtagaatgccgtatcaatgccgaagatccgaacaccttcctgccaagccctggcaaaatcacgcgcttccatgcgcctggcggctttggcgttcgctgggaatctcatatctacgcgggctacacggtgccgccgtactatgattccatgatcggcaaactcatctgctacggtgaaaaccgcgacgtggcgattgcccgtatgaaaaatgccctgcaggaactgattatcgatggtatcaaaaccaatatcgatctgcagacccgcatcatgaatgacgagcacttccagcacggtggaaccaacatccactatctggagaaaaaactcggtcttcaggaaaagtaatcgcacgttaatctcaaaaggccggtgaatccggccttttttatttctggggatagcgatgccccatcatgtacaattcccgctttcttcacccataagggacaaaaaatggacgctcgttttgttcaggcccataaagaggcgcgctgggcgctgtggctgaccctttgctatctggcggcatggttagtggctgcttacttatctggagactcgccgggaattaccggtctgccgcactggttcgagatggcctgcttattgacgccgctggtctttattttgctgtgctgggcgatggtgaaattcatttatcgcgatattccgctggaggatgacgatgcagcttgaggtcattctaccgctggtagcctatctggtcgtggtcttcggggtctcgatttacgctatgcgcaagcgtaccgccggcacctttttaaacgagtattttcttggcagtcgttcgatgggcgggatcgtgctcgcgatgacgctgaccgccacctatattagcgccagttcatttatcggcggtcccggcgcggcttataaatatggtctgggctgggtcttgctggcgatgatccagcttcccgccgtctggctttcactgggtattctgggtaaaaaattcgctatcctggcgcgtcgctataatgccgtcacgcttaacgatatgctattcgctcgttaccaaagccgcctgctggtgtggttagcaagcctgagtttattggtcgcgtttattggcgcaatgaccgtacaatttatcggcggcgcgcgactactggaaaccgcggcgggaattccctacgaaaccggcctgctaatatttggcgtcagtatcgcactctatacggcgtttggcggctttcgcgccagcgtacttaacgatacgctacagggcctggtgatgctggtcggcacgatagtgctgctggtgggcgtggtgcatgcggcgggcggtttacatcaggccgttgacacgctgcacgctctcgaccccaaactggtaacgccgcagggcgccgatgacatactttctcccgcttttatgacctctttttgggtactggtctgttttggcgtgattggcctgccgcatacggcagtgcgctgcatttcttataaagacagtaaagcggtacaccggggcattattatcggtacgattgtcgtggcgattttaatgttcgggatgcaccttgccggcgcgctgggtcgcgcggtgcttccggatctgacggtgccggatctggtgatcccaacgctaatggtgaaagttttgccgccgtttgccgccgggatcttccttgctgcgccaatggcggcgatcatgtcaacaattaacgcccaactgctgcaaagttccgcgacgatcattaaagatctctatctcaacctgcgtcccgatcagatgcaaaatgagatccggctgaagcgtatgtcggcagcgattacattactgttaggcgcgctgttgctgctggccgcgtggaaaccgccagagatgatcatttggctcaacctgctggcgtttggcggcctggaagcggtgttcttatggccgctggtactgggcctttactgggagcgggcaaacgcggcaggcgcgttaagcgccatgatcgtgggcggcgtgctatatgccctgcttgccacatttaatattcagtacctgggctttcatccgattgtgcccgcgttactgttaagtttattggcttttctgatcggaaaccgattcggctcttccgcttcgcaagccaccgtattgtctactgataaataaagagttttgccatgccatggatccaattgaaactgaataccaccggcgcgaatgctgaagagctaagtgatgcgctgatggaagcgggcgccgtttccattacctttcaggatacacacgatacgccggtttttgagccgttgccgggcgaaacccgtctgtggggcgataccgatgtgatcggtctgttcgacgccgaaacagacatgaaagacgttgtcgcgattctggagcaacatccactgctgggtgccggatttgcccataaaatcgaacaactggaagataaagactgggaacgcgaatggatggataatttccatccgatgcgttttggcgagcgtctgtggatttgtcccagctggcgtgacattccggacgagaatgccgtcaacgtgatgctcgacccgggactggcgttcggtacgggtacgcaccccaccacctctttatgtctgcaatggctggacgggctcgatctcaacggcaaaaccgtgatcgactttggctgcggttcaggcattctggcgattgccgcgctgaagctgggagcggcaaaggcgattggtattgatatcgatccgcaagctattcaggccagtcgcgataatgccgaacgtaacggcgtgtctgaccggctggagctgtacctgccgaaagaccagccagaagccatgaaagccgacgtggtcgtcgctaacatcctggcaggcccattacgcgaactggccccgttaatcagcgtactgcccgttgagggcggtctgctggggctttcaggtattctcgccagccaggcggaaagcgtctgtgatgcttacgccgagcttttcactctcgacccggtcgtcgaaaaagaagagtggtgccgcattactggccgtaagaaataattcttgtcagcgtggtcgcccggccacgcttttctccacacaactgccttaacgcctttcaggcaccgagacatcattaaattcatcaaatgaatgcctgaaataacttctttgtcactatccgtctggataaacagctgctaccagcggacaaacgtactggcgcttcaacggcccgcagccatcgccctcgtacttagtaaatgctgtccgggttgttctgcagcatccgctaacgctctttttagcgcagctggaaaaatttatgcgtgccgttcatgaacacaaaagcgcatctgtgcaccccttccgactggcaatggagaaaaatcacgcgcagcgggaagtgatcttgtcctgaaacgagacggcgatcccattcatttggggtaattagcttataaaaaaagcagattattccgcttatcttgtttctggtcgaagaaatagagagaagttacgggaatttgtaagcgcgtacaaaaccgccgacaataaataaccctatgattttactgaattataaatttattttgctgtttttaagcacgattcattgatctacaacagtggattgttcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattactgacagacctttccggacgctgtgctatgagatgggagcaggattgacagtatccgagatgatgtcttctaacccgcaagtgtgggaaagcgataaatctcgtttacggatggtgcacgttgatgagccaggaattcgcacggtgcaaattgccggtagcgaccctgttgagatggccgatgccgcacgtattaacgtggaaagcggcgcccagattattgatatcaatatggggtgcccggcgaagaaagtgaatcgtaagctggcaggttcagccctcttgcagtacccggatttagtgaagtctatactcatcggggtcgtaaacgcggtggacgttcctgtgactctcaagattcgcaccggctgggcgccggaacaccgtaactgcgtagagattgcccaactggctgaagattgtggtattcaggccctgaccatccatggccgcacccgcgcctgtttgttcaacggagaagctgaatacgacagtattcgggcagttaagcagaaagtttccattccgattatcgcgaatggcgacattactaacccgcataaagccagagctgttctcgactatacaggggcggatgccctgatgataggccgcgcagctcagggaagaccctggatctttcgggaaatccagcattatctggacactggggagctgcttccgccgctgccgctggcagaggtaaagcgcttgctttgcacgcatgttcgggaactgcatgacttttacggtcaggcaaaagggtaccgaatcgcgcgtaaacacgtctcctggtatctccaggaacacgctccagacgaccagtttcggcgcacattcaacgctattgaggacgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggacgttaatgacctgtatgagctggtactggctgaagtagaacagcccctgttggacatggtgatgcaatacacccgtggtaaccagacccgtgctgctctgatgatgggcatcaaccgtggtacgctgcgtaaaaaattaaaaaaatacggcatgaactaatttcgattagctaactgcttgtttaaaaaggcgctactcggcatggggaagcgccttttttatacgcattacatggaatttggtcatgaaagcggaatgtgaacctcagtactttggcgatgaatcgaagaagattattcacggtgacgcgctaacagaacttaaaaaactgccttctgaaagcattgacttaatttttgccgatccgccttacaatatcggaaaagatttcgacggtatggtggaatcctgggacgaagcgtcttttctggcctggctgtatgaatgcattgacgagtgccaccgcgtactgaagaaacacggcaccatgtacatcatgaatagcacagaaaatatgccgtatatcgatctcaaatgccgaacgctttttaccatcaaaagccgtatcgtctggtcctatgatagttccggggtgcaggcgaaaaaatactttggttctatgtatgaaccgatcctgatgatggtaaaaaacccgaaaagctatacctttaaccgtgacgcgattctggtcgagaccactacgggcgctaagcgcgcgctaatcgattatcgaaaaaacccgccccaaccatacaatcagaaaaaagtgccgggcaacgtctggtcatttcctcgcgtacgttatctgatggatgaatatgaaaaccatcctacgcaaaagcccagcgcgctgttaaaacggatcatactggcctcttctaacccgagcgataccgtattggaccctttcgcgggcagtttcaccacaggcgctgtcgcagcggcgtcaggtcgtaagtttatcggtattgaactcaataatgagtacgtaaaaatggggctcagaagattgagcgtcacttcgcattattcagaaaatgaacttgcaaaagtcaaaaagagaaaaacacaaaacctgtccaaaaagcagcgaaatgtcgggataaacgcgctatcttcagagaagtaaaagcattgtaagtccgcttttcagcgtcaaaatttcatgtatattcccagcacgcatgggcatgaatacacaggatttgacgatgatacgtaagtattggtggctggttgtttttgccgtctccgtttttctttttgatgcgcttttgatgcaatggatcgaattgatggcgactgaacaggataagtgccgaaacatggattcggttaaccctcttaaattgatcaattgtaccgatctggagtagcgaatcgggcgatttaacctatgattatttatcacccggatttcttttatcccttataaaaacagggaattaaaacacgttgaggataaaagaaggggtgatactgtctcgtcctgttcttttcctgcataaccaatgagctaatgatacatgccggttagtgagtacaaccacatccttgtggcggtttcatttgctgtcgctatttttgcgtcctataccgcattaaatatggccggacgcgtagccggaagcgcccgatcaaacgccagaatatggctaatgggcggcggcttcgcgctgggcgtcggtatttgggagatgcattttgtcgggatgctggcgatggatcacgcgatgaacatgcgcttcgatccgttcctcaccggcctctccatgctgatcgcgatcggctcctccctgtttgcgctatggctggttagcgctgaaaaactgcgcctgcgccgtttactgccgggcgcgctggtgatgggactgggcatcagcgcaatgcattataccgggatggcggcgctgcaatttgcttccattatcgtttggaatagcgcgtgggttgccctctctatcattatcgcgctactggcgtcctgcggcgcgctgtggctcacgttccgcctgcgtaatgagggaacagatgtcgccctgaggcgagcaggcgccgcggtattaatggggatagctatcgccggcatgcattacgccggcatgaaggccgcacactttccccaaaactggccgatggaacatcgtggcgtcgatagcaactggctggctgttcttgtcagcgtggtcgcgctgactatcctgggtattactctgctggtttctttatttgacgcccggcttcaggcccgtaccgcactacttgcctcttcgctggcgcaggcgaaccaggaactggcgcagttggcgctgcatgatacgctcacccgtttaccaaaccgggtactccttgaggatcgtctggaacaggccatcagcaaagcgaatcgggaaagcacgtctttcgcgctactgtttatggatctggatggctttaaagccgttaatgacgcttatggtcatgatattggcgataagctactggtggcggtcacgcatcgtctgaaccaaccgctgagcgggcagtttaccctggcgcggattggcggcgacgaatttgtgctgcttgcggaagtcagcgcgcctgacgaagcggcttcccttgccagcgcgctggtacattcgatagatgcgccctttacgatagatccgtacgaactggttgtcacccttagcgtgggaatagcgctctatccgctggacggaaaaaacgaacgggaactgatgttcaacgccgatgccgcgatgtaccacacgaagcatacggggcgtaacggataccatttctttcagccatcaatgaatatgctggcgcaaacccaacttcagctaatgaatgacctgtggctggcgctggaaagacaagagctcaggctggtgtatcagcctaaatttcaggctcctgccggccccattgtaggatttgaggccctgttgcgctggtatcatccaaaacaaggcgtactgaatcctgaccagtttttaccgctggcggaaaaaacgggtcttatcgtcactatcggtagctgggtgatagacgaggcgtgtcgacagctccgcgagtggcacttacagggatacgccttatggtcagtggcggtaactggtaatggaaaatggtcaggtctacccgattaaaggcacgctgcaattttccgacgttaccgtagatgaaagcaccggctctatcacgctcagggcggtgttccctaacccgcaacacagtctgcttcccggtatgtttgttcgcgcccgcatcgatgaaggcgtccagcccaatgccatccttgtcccccagcagggcgtgacccgcacgccgcgcggcgacgcaatggtgatggtggttaacgataaaagtcaggtcgaagcccgcaatgtcgtggcgacgcaggctattggcgataaatggctcatcagcgaagggttaaaaccgggcgataaggtcatcgtcagcggcttacaaaaagcgcgaccgggcgtccaggtgaaagccactaccgatgctcctgcagcgaaaacggcgcaataaggtaaccgtacatggcaaacttttttattagacgtcctattttcgcctgggttctggccattatcctgatgatggctggcgcactggcaataatgcaacttcccgttgcgcagtatccaaccattgcgccgccagcggtttctatttctgcaacctatcctggcgcggatgcgcagacggtacaggatacggttactcaggttatcgaacaaaatatgaacggtatcgataacctgatgtatatgtcctctaccagcgactctgctggtagcgtgaccatcactctgaccttccagtccggaaccgatccggatatcgcgcaggttcaggtgcaaaataaattgcagctcgccacgcctttactgccgcaagaagtccagcagcaggggattagcgttgaaaaatccagcagcagctttttgatggtcgccgggttcgtctcggataatccgaacactacccaggacgacatctctgactatgtcgcctctaacattaaggattctatcagccgtctgaacggcgtgggcgacgttcagctatttggcgcacagtacgccatgcgtatctggctggatgcgaatctgctaaataaataccagctcacgccagttgacgtcatcaaccagttaaaagtacagaacgaccagattgcggcaggccaactgggcggtacgccagcattaccgggccagcagcttaacgcctcaatcatcgcccaaacgcgtctgaaagatccggaagagttcggcaaagttacgttgcgcgtcaataccgacggctctgtcgtccatctcaaagatgtcgcgcgtattgagcttggcggtgaaaactataacgttgtagcgcgcattaacggtaaaccggcctccggtctcggtattaaactggcgaccggcgctaacgcgctggataccgcaaccgcaatcaaagcgaaactggcggaactgcagcctttcttccctcagggaatgaaggtggtttatccttatgacactacgcccttcgtaaaaatatctatccacgaagtggtaaaaacgctatttgaagcgattattctggtgttcctggtaatgtatctgttcttacagaatatccgggcaaccctgattcctaccatcgctgttcctgtcgtgttgctaggcacttttgcggtactcgccgcctttggctattccatcaataccctgacgatgttcggcatggtactggcgatagggctgctggttgacggtgcgatagtggtcgtagaaaacgttgaacgtgtaatgatggaggataacctttctcccagagaggcgacggaaaaatccatgtcgcagatccagggagcgctggtcggtatcgcgatggtactgtctgcggtatttatcccgatggccttttttggcggctcgaccggggcaatttatcgccagttctctattactattgtttcagcaatggcgctatccgttctggttgcgttgattctgacgccagcgctatgcgctacgctgcttaaacccgtatctgctgaacatcacgagaaaaaaagcggcttctttggctggttcaataccaggtttgaccacagcgttaaccactatactaacagcgtaagcggtatcgtgcgtaatacgggtcgctatctcattatctatctacttattgtagtcggaatggcggttctgtttttacgcctcccgacctccttcctgccggaagaagatcagggggtattcctgactatgattcagctcccctctggcgctacgcaagaacgtacgcagaaagtgctggatcaagtcactcattactacctgaataatgaaaaagcgaacgtcgaaagcgtgtttaccgtaaacggctttagctttagcggtcagggacaaaactcagggatggcatttgtcagccttaaaccctgggaagagcgtaacggtgaagaaaatagcgtcgaagccgttatcgccagagcgacacgcgcctttagccagattcgcgacgggttggtgttccccttcaacatgccggcaattgtcgagttaggtaccgcgacaggtttcgacttcgaactgattgatcagggaggactcggtcatgatgcgttaacaaaagcgcgtaatcaactcctgggtatggtcgcgaagcatcctgatctattagtgcgcgtacgcccgaacgggctggaagacacgccacagttcaagctggatgtcgatcaagaaaaagcacaggcgctcggcgtttcgctgtctgatatcaacgaaaccatctccgcggcgttgggcggctattacgttaacgactttatcgatcgcggacgagtgaaaaaagtatacgttcaggctgacgctcagttccgtatgctgccggaagatatcaacaatctttatgtacgcagcgccaatggcgagatggtgcccttctctacctttagctcagcacggtggatttatggttcgccacgcctggaacgctataacgggatgccgtcaatggaactgctcggtgaagcagcgcccggacgaagtaccggtgaagccatgtcgttaatggaaaacctggcttcacagctgccaaacggtattggctatgactggacaggtatgtcgtatcaggaacggttgtcaggtaaccaggcgccggcgctgtacgcaatctcactcattgtcgttttcctctgccttgccgctctgtatgaaagctggtcaattccgttctcggtaatgctggtcgtaccgctccggcgtggttggcgctctgcttgcagcgtcattgcgcggcctgaataatgacgtttacttccaggttggcttgttaaccactattggcctttctgctaaaaacgccatcctgattgttgagttcgccaaagatctcatggaaaaagaaggacgtggattgattgaagcgacgctggaagcatcccgtatgcgtttacgtcctattctaatgacctcgctggcctttattctcggggtaatgccgttagttatcagtcgtggcgcaggtagtggggcacagaacgcagtaggcacaggggttatggggggaatgttaaccgcaaccttattagctatcttcttcgtgccagtattcttcgttgttgtaaaacgccgatttaatcgccatcatgattaaccagtaaacagaggcgtcttcggacgccttttaaacggtacgtctttatctccgctattcccccctctccgcttacctctgcattctccatagtttttacaattcacatgaattgagatgattcctcatgtcagccattttttctgtggtggtaaaataactctcgttttcacagcggttagagccagcatttacgttgctgtactttgcgaaacgctgattaatgaggtaacaccatgaaaagactaattccagttgcattgcttaccaccttattggcaggttgtgcacatgattctccctgcgtaccggtttatgacgatcaagggcggctggttcataccaatacatgtatgaaaggtacaacgcaggataactgggagacagcaggcgctatcgctggcggcgctgcggcggtagcagggttgacgatgggtatcattgcgctttctaaatgatacatgcaggcgcggcaatgccgcgctttcagtaataatataaaggtcgtaaggatactcagcgacgtaatctattcagcctatccccgaaagttaacacgataaaacgctctcttttcttactcgcccatcccgatggtatttattctattccttgtccgatgcagacaaaattgtagcttgatagcatcgtaagccgcattacaaacaggctttatacagtaagacttagagcgtggtcattaggcgtaattattacagacagtctggatataaaccggaacatacacgtaatacatgaggattttgagcactgtcccagggccaaactggcaaataaaatagcctaatgggccagattcttagtcctcagcgaatatctctattgcttattagaggcgtaagtaaaagccgtttgtacatctacttcagcacggttcacattcgatggttcaggcggatatatggcgggaaatcacgtttactaaaacggtttttatccactctacgaagatgttatatacccaaaataattcgagttgcttaaaggcggcaagggagtgagtccccaggagcatagataacgatgtgactggggtgagcgacaaatctgccgggagcagatttaaacgtcgcgtgcgacggcccgtcagggcgaggcccatgaatgggccgagtaatccgtagccaacacataagcgacttgaagtatgaaaggtataaaccaaatataaaacgcgtcggcgtcattatccgataactttttccatagagagataaatgcaaaaaggcccaatctttcgattgggccttttgctttatttgatgtctggcagttccctactctcgcatggggagaccccacactaccatcggcgctacggcgtttcacttctgagttcggcatggggtcaggtgggaccaccgcgctactgccgccagacaaattctttttcaaatgccgaactttaaccgtattaagtggtgctgatacccagagtcgaactggggacctcacccttaccaagggtgcgctctaccaactgagccatatcagcacactaaatttgatgcctggcagtttatgaatcacttcgtgattcacccttcgggccgttgcttcgcaacgttcaaaagattcgcttttgtcctactctctgtcgagtagtgaactgccccgaaagttaatgccatacttctaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaaacgtactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataattttctgagtgcgcactttttattctttgcgtttattttgccgacgatttgttggttaaatgggctatttcacgggcaaagtgcgcaacttgctcccagtcggtgtacaccacttctttactggtatccgtttcgccgcccgacatcttcataataagcttgatcatcagacggtcataccagcgatagcggggatagcgaagcgcgcctgcaatgacggcacagtagtcaggtcgccacggagaactcattaaaaacttacgcgcgtagctgttagtctgcggcgtccgtttttcagctttacgcgccaccaggttaacggaataaaaggcgctcggcattccgttcaaccgcgtggcatatttcttaacaaactcctgaaaggcgctgtggtaatgaccataacgaatagacgcgccaatcactacgcgatcatagctatcccagtcagactcttctgcgcgatgcagattaacgacatcggcccagatccccatctctttgagttcagaagccagataagaggcaatttcgcgcgtttgtccgtcccgggtagagaaaagaatcaatgttttcacgtgttactccattattcacgccagaaagtcggggtaaaaagtaccagcaaagtgaatacttccagacgaccaaatagcatgttggcgatgagtatccatttcgcaaccggattcatactggcgaagttatcagcaaccacccccagccccggtcccaggttattaagcgtagccactaccgaggcgaaagccgagaaatcatctacgcctgtagcgataatggccagcatactgacgataaataccagcgcgtaggcagaaaagaatccccagacggcttccagaatacgctctggcagcgcccggttccccagcttaatactgtaaacggcattcggatgcaccagacgtttgagttcgcggttcccctgtttaaataacaacagaatacggatgacctttaaccccccgcccgttgacccggcgcaaccgccaataaacgcggaacatagcagcaagacgggcaaaaacagcggccagcgcgcaatgctgtccgtggtaaaccctgccgttgtcgccatcgacacaacctggaagaacgcctgatttagcgttgtcagcgccgagtcgtagatattatggaaccacagtaccagcgtgcagatcaccaccagcgtcaactgtacgccgatgaacatgcggaattccggatcgcgccagtataccttcaggctacgcccgcttaataaagagaaatgcaggccatagttacaaccggagatcagcaggaaaatagcgatgatggtattaatagtgggactatcaaaatagcctacgctggcgtcatgcgttgagaagccgccgatagcgatagtggagaagctgtgtccgatagcgtcaaacgcgggcatccctgcaaaccatagcgccagcgcgcaggctaccgttagcaagacatagataagccacagcgttttcgccgtctcggcaatacgcgggcgcattttgttatctttgagcggccccggcatttctgcccgatagagctgcatccccccgacgccgaggacagggagaatcgccaccgccagcacaatgatccccataccgccaaaccattgcagcatctgacgataaaagagaatggcgtgcggtaatgaatccagccccaccagcgtagtggcgcccgtggtggttaacccggagaacgattcaaaaaaagcatcggtaatggtgaggtttgggctttccgagaaaataaacggcagcgcacccacgctgcccagcacggtccagaacagcaccacgataagaaatccttcgcgggatttcagctcgcccttttccctacgatttggccaccacagtatggaaccgatcgccagcgcgacaaaaaaggtctgcgtgaacgctcctcctgcgccatcacgatatattagcgctaccagtcccgggagaatcattgtccccgaaaataagataaccagtagtccaacgattcgggtaatggcgcgaaaatgcatctctgccgcttcctttattcttaaaaatgaggtggggattattcttcaatcgctaacaattgcaatgaaccacggctaaaatccgccagttttgtggaaaatgcattcacatgagcaaaaggaagcgccaccctgagccgaacagacgcctgataatcgctggaaacgatcttcccggcaaactgtcctaataatgcttcgattccggccaactgaccgtactcacactgcaaagtatattcggttaatggcgtcttgcgttgtgtggcaagctgacgtaatgcctgattcacaccgccgccataggcttttaccagcccgcccgtacccagcagaataccaccatagtagcgcacgacgacggcagtaatttctccgacgccgctgcccatcaattgcgcaagcatcggcttgcctgccgttcccgccggctcgccgtcgtctgaaaagcccagttgttgtgagtcgtccggcgcacccgccacccacgccgcacaatggtggcgcgcatcagggtgctcagctctgactaactcaacaaacgctttcgccgcctctacgccatcggtatgcgccaatagcgtaataaagcggctttttttgatctcttcaacaacggtgaccggcgctgcagggattaaccaactgtccattacgccagttttaaatcccgcgtcatgttttccacgccgttttcgtggatgaccacgttatcttcaatgcgaataccgccgaaaggcttgagcgcttcaattttctgccagttgaagtgcttgctgaatggcccttcgcgccacggcgctaacagcgattcgatgaagtaaatccccggttcgatggtcaacaccattcgcggctgtaacacacgcgtgcagcgcagatacgggtatttggacggcgcggcgagatgcgtaccggaatcatcctgcataaacccggccacatcgtgtacctgcagacccaacggatgaccaataccgtgcggcataaacggcccggtgagatcattttccaccatcgcctcttcactcatgtcggtaatgatttgatgcttacgcagcagctttgcgatgcgctgatggaactgaatatgataatccacatagctaacgcccgccttcatggtagcgatcagcgccaactgttcgtcgttaacatctttcaccaggtgggcgtagtcgttatcgcttttcgccgaccaggtccgcgtcagatccgccgcgtagccgttgtattccgcgcccgcatccagcaggaaactgcgcatttcagacggtgcctgatgatccagtttcgtgtaatgcagcacggcggcatgttcgttcagcgccacaatgttgctgtacggaacatcggtatcgcgatgtcccgtggcggtcaggtacgccaggttgatgtcaaactcgctcatgccggaacggaaggcctcttccgccgcccgatgaccgctcaccgccattttctgcgcttcgcgcatacaggccagttcataatccgttttataggcgcggtagtaatgcagatagtcgataacacctttcgggttgatgttgctggcggcgatatccaattgtagcgcgcgctcaggaaccgggccgatatagccgatattgccacgcgcggcaggaagttggctgccgatgccatccgctttcggtaaggcgacgacctcgacttcttctgtccagaatgacgttggcagcggttcaacgttatgccagtaatcgaccggcagataaaaccacaatttgggtttgttgacgccatcgaccagcagccagcaatttggaacctgagttaccggcacccacgctttaaactgcggattgaccttaaacggataagggtgatcgtcgagaaagacgttgaaaagctcgccggaatgaataagtaacgcatccagcttaaagcgcgccagaacatcgcgcgtccgttcttgtaaggtaacaatatgatttttatagagcgcggccagtgattccattttttacccttctgtttttttgacctcaagtttccgcatcttagcacatcgccccacgagagcgtgatctctgccgagcgtgatcacatcggcatttctttaatcatttatttgcattttattaacacaaaatacacacttcgcttcatctgatacgaccagatcaccttgtggattcaggagactgacatgctttataaaggcgacaccctgtacctcgactgactggaagatggcatcgccgaactggtgttcgatgctccaggctcggtcaataaactcgacaccgcaaccgtcgccagcctcggccaggcgcttgaggtgctggaaaagcaacacgatttaaaagggctgctgctgcgctctaataaagcggcctttattgtcggcgcggacatcaccgaatttctttcactgttcctcgtccccgaagagcagttaagccaatggctgcatttcgctaatagcgtctttaaccgtctggaagatttacccgtaccgacccttgccgccgtaaacggctatgcgctgggcggcgggtgtgaatgcgtgctggcgaccgattaccgtctggcgacgccagacctccgtatcggtctgccggaaactaaactgggcatcatgccgggtttcggcggctccgttcgtctgccgcgtatgctgggcgcggacagcgcgctggagattatcgcgacaggtaaagatgtcggtgctgagcacgcgctgaaaatcggccttgtggacggcgtggtcaaacaagagaagctaattgaaggcgcgatagcggtgttacgccaggccattaccggcgatctcgactggagagctaaacgccagccgaaactggaaccgttgaaactcagcaaaattgaagcggcgatgagctttaccatcgctaaaggcatggtcgcacaaacggcgggtaaacattatccggcgccgatgaccgcagtgaaaaccattgaagccgccgcgcgttttggtcgtgaagaagcgctgaatctggaaaataaaagctttgttccgctggcgcataccaatgaggctcgtgcgctggtcggtatcttcctcaacgatcaatatgtaaaaggtaaagccaaaaagctgaccaaagatattgagacgccgaaacaggcagccgtactgggcgcgggcattatgggcggcggtatcgcttaccagtcggcctggaaaggcgtaccggtcatcatgaaagatatcaacgataaatcgttgaacctcggcatgaccgaagcggccaagctgctgaacaaacagctggagcgcggcaagatcgacggtctgaagctggcgggcgtcatttcgaccatccacccgactctcgattatgccggtttcgatcgcgtagatgttgttgtcgaagcggtagtcgaaaatccgaaagtcaaaaaagcggtactggcggaaaccgagcagaaagtgcgcccagaaaccgtgctggcctcaaatacctccaccatcccaattggcgaactggcaagcgccctggaacgtccggaaaacttttgcggaatgcacttcttcaacccggtacaccggatgccgctggttgaaatcattcgcggcgagaagagttcagacgaaaccattgccaaagtcgtcgcctgggccagcaaaatgggcaagacaccgattgtagtcaacaactgccccggcttctttgttaaccgcgtgctgttcccctatttcgccggtttcagtcaactgctgcgcgacggcgcggatttccgcaaagtcgataaagtgatggaaaaacagttcggctggccgatgggcccggcctatctgctcgacgtggtgggtattgataccgcccaccacgcgcaggcggtaatggcggcaggcttcccacaacggatgcagaaagagtatcgcgacgcgatcgacgcattgtttgacgccagccgttttgggcaaaaaaacggtctgggcttctggcgctataaagaagacagcaagggtaagccgaagaaagaagaagatgctgcggtggatgacctgctggcaagcgtcagtcagacgaaacgcgacttcagcgacgacgagataatcgcccgtatgatgatcccgatgattaacgaagtggttcgctgtctggaagaaggcattatcgcaagcccggcggaagccgatatggcgctggtctacggcctgggcttccctccgttccacggcggcgcattccgctggctggatacacagggcagcgcgaaatatcttgatatggcgcagcagtatcaacacctcggcccgctgtatgaagtgccggaagggctgcgtgataaaacgcgccataacgaaccgtattatcccccggttgaaccagcccgtccggttggttctctgaaaacggcttaaggagtcacaatggaacaggttgtcattgtcgatgccattcgcaccccgatgggccgttcgaagggcggcgcgtttcgcaacgtgcgggcagaagatctctccgcccacttaatgcgtagcctgctggcgcgtaatccgtcgcttacagcggcgaccctcgatgatatttactggggctgcgtacaacaaacgctggagcaaggcttcaacattgcccgtaacgccgcgctgctggcagaaattccccattcggtaccggcggtcaccgtcaaccgtctgtgtggttcctcgatgcaggcgttacacgatgcagcgcgaatgatcatgaccggcgatgcgcaggtttgtctggttggcggcgtggagcatatggggcacgtgccgatgagccacggcgtggattttcacccgggtctgagccgcaacgtcgccaaagcagcagggatgatggggctaacggcggaaatgctctcccgcctgcacggcattagccgggaaatgcaggaccagttcgccgcgcgttctcacgctcgcgcctgggccgccacccagtctggcgcattcaaaacggagattatcccgactggcggtcatgatgcagacggcgtgttgaagcagtttaactacgatgaagtgatccgcccggaaaccacggtcgaagcgctatcaacgctgcgtccggcatttgatccagttagtggcacggtcacggcgggcacctcatccgcgctttccgatggcgcagccgccatgctggtaatgagcgaaagtcgtgcccgtgagctgggtctgaaacctcgcgcccgtattcgctcaatggcagtggtgggttgtgatccgtcaattatgggttacgggccggttccggcgtcaaaactggcgttgaaaaaagcgggactgtcggccagcgatatcgatgtgtttgagatgaacgaagcgtttgccgcacagatcctgccatgcattaaggatctgggattgatggagcagatagacgagaagatcaacctcaacggcggcgcgatcgcgcttggccatccgctcggctgctccggagcacgtatcagcaccacgcttatcaacctgatggagcgcaaagacgcgcagtttggtctggcgacgatgtgtattggtctgggtcagggcatcgccacggtgtttgagcgggtttaattaaagataatgtcccctaaataattcacgttgcagcgcggcggcaactgagcgaatccccgggaacatagataactatatgcccggggtgaacaaaggcagccaacaaagaggcagcgtgagttatgacggggaacagtttagttgccgtttttcccgcccgtcaggggcgggttttttcaccgtgtggcctgctctactcagtaagcgctttggtcaggctaaatggcatagcctgatatccacgcgcaccatgtatttgcatttcgaccgcaggctctttttctccccatctgaactcttccagatacgggttaggcaagctggtaaatgcgcctaccgacaaatcaaactcaccacctgctgttgcggaatacacgaacacagaattcttgtcagtctggtactcggtgatagaggttaccgggctaaaccactcgttcccgcgctctttaccgtattgccagatctgttggactgtcttgtttttctggtcgattttgtaaatcacggagcggctgtatttcatactctgcatagcaggctgttctaagccgcggccatcaccattgtcgaaagcggaaaggtataagatatcgcctttactcttactatcaattttaaaggccgtatgttgcgtccatgtccaatcgaagtcaccctcacagccactttcctggcaggaaattttttggcctttgctatccacaggcgtcagaattgcggcattaaatggcgctttccagccagcaggcgtaccaagtatccacttcactttcttatcgcgaccgattttgataatcgcactctggtggcggaagctgatgatgatggaatcatcttcactgtcatagtcgacgctgttgacatgcgcccagttgcggccagccccactacccacgatatccccgaatttgtcggaggagtccagcgccgccagatcttcttcgctcaacgtatggccggactggctggcgtcgatattcaggcacactgcgccctgatcgagggttttcattatcacatcacgataaggatcgaggatatcaaacagacgccattcatccactaccacgccgttctgatcaacttcggcaatcacatcacgcacggtacgaacatttttcccatcaggacgtttatagttagagctggctacacgcaggaagtagtgaccgttgggcgcgttatccattgagtgtgaaaaatcgttataattatccggcaggcggcggttgaagatttcacgccccatgatatcgtatttcacataacgctgaccgtagccccacgatagtgcgccatcctggttttgtttaaagcccatcataacgccagcacgataaattgactttaaatcataaattgaacttggattcataaaccaacgaatatcaccggaggtgtcgataatagcgttagctgtagtgaagttccattctaatgcacccccagtagggttgttccagacagtacgcgttccattcccagacttatctttcgtattattcaaaagatacaagcgatctttaaattctggggaaacctttttaacatcgatagtaaagagtgctgattgttcttcttttgtacccgctgattcactataagcaggcggtgcatacattttatagctttcttttatattttcggttttactaccctggattcttgtatattcaacttcaacggtattgacataatccgggtaaagaccaaagacgggaataccgccatacgttaaaaggtatttattattaactttatacgcgatctcctggccattttctttgggtacaatccgcacatgcacgtcacgtaactggtaaccgccattacgaataacggcggttagcggcgcgatatcataggggttcataacaacttcgccaatttttccctggacctgatagtccactttagcgccgctggcgccgccgatggcgaaagcagtagaaggtactgatgacaaaattgcaacagataatgcgagagaagttaaagcatatttaaatttcataacactctccatcttataaataaataactaactttccattttatgtttcttttataaaaataaatgaagcatatataattaactatttttattgatagcctcaggacataatattacttaatttattacacgcaatacaaagcctgtagatattcaatatcataaggttttatagttgacgattaattaatatttaagaggacttttaggtaggctaacgtaaaaagggacgctactgcgtcccataaaatagttaaataaatgcgaacgcatcgccaaacagacgatcttcccgcgcattacgctcatgacagaacagatcgcgggcgattttcgccatctcaaaacgtccggcaatataaatatcgtgccccgccagcgtaccataatcctgcaataccgccgtaagtaccgttcctgtacgtccacgccagccttcttccggctgctcgacaacaggttcaatacgcaaattaggatggttaacagagagtgcttccagctcagagagatcatagaggtgcttttcttcgcgaccgccccagtaaatggtaacatcgcgggccgggttgcgcgctaacgccgtcaacaggatggagcgtgcataagaaaagcccgtaccgcccgcgatcagaatcaacggacgctcttcatcgtcacgtagccaggcgtcgccatgcggaatatcgacgacgatttcccggtctttcagaattcgatccatgaccgccatcgcatacagattgagctcggaagcgccaatgtgtaattcaataaaccctttctcgtccggcgttgaggccatcgaaaacgggcgtttgtcacgctcgtccattacgaccatcaaatactgaccagcgcggaatgaaaacgccgcgtccggcactaaacgaacccgatatacggtatcggtgatagcttctaccgaggtcactttacagcttaaggttgtcatgcgctccctctgtcgggtgtcgggtcaataccgacatttttcaagccgagtcgccgcagcctgaaatgtcgatgtccgctttcagttatttaaagatagccagctcatcccaaatcgcatcaatacgcgcggtaacttcaggatctttaacaataggacgaccccactcgcgttgggtttcgcccggccatttgtttgtggcatccagccccatttttgaacccagcccggagaccggcgaggcaaaatccaggtagtcaatcggcgtattttcaaccagcaccgtatcccgcgcagggtccatacgggtggtaatcgcccagatcacatcattccagtcgcgtgcgttaacgtcatcatcgcaaacgataacaaatttcgtatacataaactggcgcaaaaacgaccagacactcatcatgacgcgtttcgcatgaccagcgtactgctttttcatcgtcactaccgccaggcggtaagaacacccttccggcggcagataaaagtcgacgatttccggaaactgtttttgcagaataggcacgaagacttcattgagcgccacccctaataccgcaggctcatcgggcggacgcccggtataggtggagtgatagatggcatcctcacgctgcgtaatatgcgtgacggtaaagaccggaaagttatccacttcattataatagcccgtatgatcgccatacggtccttccggcgccatctctcccggctcaatgtaaccttcaaggataatctcggcgctggcaggcacttccagatcgttagaaaggcatttaaccacttcagttttcgtgccgcgcagcaggcccgcaaaggcatactccgacagagtatcgggaacaggagtcacggcgccaagtatcgtcgccggatcggcgcccaatgcgacggagaccgggaaacgttcacccggacgcgcggctaaccactcctgaaaatccaacgcgccgccgcggtgagacagccagcgcataatcagcttatttttacctatcaactgctgacgataaatgcccaggttttgccgttctttgtgcgggccacgcgttaccgtcagtccccaggtaatcagcggcgcggcgtcgtccggccaacaggtcatgacaggaagacgcgttaaatcgacatcatcgccagacgcgattttctgctggcaaggcgcgccgcgtaaccgtttcgtcggcatattcagcacttgcttaaactgcggcagcttgtcaaacagatcgcgaaagcctttcggcggctcaggttctttcagaaacgctaataatttacccacttcccgtaaggcggaaacatcatcctgccccatgcccatcgccacgcgttttggcgtgccaaaaaggttgcacagcaccggcatggcgtaacctttaggattttcaaacagcaacgccggtccaccggcacgcagcgtgcggtcagcgatttccgtgatttccagatgaggatccacaggtagcgtgatgcgttttagttccccctgctgctcaagtagcgtcaggaagtcgcgtaaatcgtgatatttcatggcgtccattgtagcctcttggtaagcgcatcattatacggcgttcatcatcgggatgctgtatttttgttaaattagcgtgaactctggcaaccaacgctaatccagatacggcttaaaggatgaagtgtataattaacttcgcgcatggcttttgctatgcttgcgccccgaacaagcggataagagtcattatgcaatcctggtatttactgtactgcaaacgcgggcaacttcagcgtgctcaggaacacctcgaaagacaagcggtaagttgcctgacaccgatgatcaccctggaaaaaatggtacgcggaaaacgtaccttcgtcagcgaaccgctctttcctaattatctgttcgttgaatttgatccggaagtgatacataccactacaatcaacgccacgcgcggcgtcagccattttgtgcgctttggcgcgcatcctgcgatcgtgccttccagcgttattcatcagctttctatctacaagcccgaaggcgttgtcgatcctgaaaccccctatcccggcgatagcgtcatcatcacggaaggcgcatttgaagggctgaaagcgatttttaccgaaccggatggcgaaacgcgttcgatgttactgcttaatttactcaataaagaagtgaagcagagcgtaaaaaacaccggttttcgcaagatttagcgatcgttcagaatacgacctcaaataaggttctggcattggcatctgtcatcgccgctaaccattgcggatcttcaccacgccatagcgctatgcgctccaggatgtgaggcagatatgcgggctcgttgcgtcgtgacgttggtttcggcgtaagatcgcggggcaacagatacggcgcgtcggtttctatcagtagcttttccgctggaataaacggtaagagttcacgtagctcaagcccgcgtcgttcgtcgcaaacccacccggtaataccgatatagagccctctgtccacacaggcctgcatttgctggcgtgaaccggtaaagcagtgcagtattgcaccaggaagactatccagccagggatcaagcaatgccagaaatcgctcatgcgcgtcccggcagtgcataaagattggcatctgcaattcggcggcaatttgtagctgcgcctgaaaggcacgctcctgctcctgcggcgtggaaaaattgcgattgaaatccagcccgcactcaccgatagcgacgacttccggctggttcgccagcgcaataatggcgtcttcagacgcagatgaccactgactgctgtcatggggatggacgccagccgtcgaccaacaatgggggtagcgccgcgccagttttaacgcctgctgactttcatggatgttcgttccggtcagtagcataccttttactcctgccgcaaacgcacgggcgaccacatcatcacgatcttttgcaaactggctactggttaaattaacgccaatatcaaacatgcttgcccccatatgacaaccgccctggcgggcggttgtgtttagtcttcagtgtgctcggccttttcggtctcggcctcgttatcttcgtcgcgcgtccgtcgcttaccgacataaaagcgtgagcagaaaacgccaatttcaaacaggcagtacatcggtatcgccagcaacgtttgcgagaagacatctggcggcgtaagcagcatccccacaatgaatgccccgaccaggatataaggccgttttttacgcaaatcttctggcgtggtgatgcccatccagcacagcaacacaatcgccaccggcacctcaaaggctacgccaaaggccataaaaagcgccatgacaaagctcagatagctggcgatatctgtcgaaacctgtaccccttccggcgccgtatgcgtcaggaaaccaaaggccaaagggaatacgacaaaataggcgaaggccataccaatgtaaaaaagcagcgaactggataccagcagcggtacgaccagacgacgctcgtgtttatacagcgccggggcgataaaggcccaaacctggtacaaaatgacaggcgcggataagatcaaagacaccatgaaggtgagtttgataggcgtaaaaaacggcgacgccacatccgtcgcaatcattgtcgccccttgcggcatctgttttatcagcggtgcggcgactaaatgataaatatcattggcgaaataaattaacgccagaaaaatcagaagtactgcgacgatgcagtttagcaggcgcttacgcaactcgatcagatgcgtgataagcggttgagtatcttctacagccatgtttacggtttatcactcgacgaggggaaagattcgacaacaggcgcagcggatttcttctcggcgtctatcgcggctacggaagcggtttccgtcgactcaggcacgttagctttaacgggctccggcttttgttccggcgcgctcgcctgtgtttcagcggcggcaggggtgacgccctcatgctgcgtttcgttcccttttaccaccggattatggatggtatgcgcttcatcgctcgcttgttcgggatcgttagcgctgtaggtgcgtttcatcgactccgccgcctgacgcagttcatccatagatgctttcagttcgggagtcagattttccaggctcgccttttcgacttttttcagactgtcctggaactcctgaagtttcagttcctgagtcagttcattctgaaccgttgtcgcaagggagcgcaacgcgcgaatccagcccgctaccgtttttaccgctactggcaatcgttgcggccccaacacaatgaggccgataacgaacactaacagcagttcgctaaaaccgatatcaaacacggattatacctgctctttatcttggcttttagcgtcttcctttttcgcttcgccttgcttatccgcgatagatttagcggtaaaatcagcgtcctgactggttttatcctgtttggcatcatcatcgctcatggcctttttaaagcctttgatagacgcgccaagatcggaaccgatggaaccgagttttttggtgccgaacagcagtacgacgataacggcaacaatcaacaactgccaaatactgataccacccatacatgttcctctgtgatagatgatgaattattagggccgcattatacacattatccttcgcgctgcctctttgttagccgctttcgcccgtcctattcacatacttttacatacgaccgggacgacattgacttgcggcctgagtattgcctcgagtgataatatgtacctgcgtgacacaaccggcgttgagcgataaaaaatctcaacgagttttacgccagccaaccagccagaccactacgccgccgaccatgagccagccaggcatcaatccccattcagggcggttgacgagtaagaatgacccgctcagtaacagcgttgcgccaattcccaataaataacgagactgactttggcgcacatggtttacctgtaactcgcgcgcaatcttatcaacactgtgctgtaaatatttgccctggcgcaaactgtcgtacaccagttcaggtatttctggcattttttcgacccagaacggcgctttttctttaagagcccgcgtgagagccggaatacccacctgatctttgatccaggactcaagaaacggcttcgccgttttccacaaatcaagctgaggataaagttgccgcccaaccccttcaacatacaataatgttttctgcaacaacaccagttgcggctggacttccatgttaaatcgacgcgctgtattgaaaaggtttaacaacacatgaccaaacgagatttccgcgagcggcttttcaaaaataggttcacagacggtgcggatggcaaactcaaaatcttcaacgttggtatctggcggaacccaacctgaatcgacatgcagctccgccacctttcggtaatcgcgattaaaaaacgcgataaagttttcagccagataacgcttatcttctttgtttagcgacccgacgataccgcagtcaatgccgatatattgcggattttcagggtgttcatgactgacaaaaatatttcccggatgcatgtccgcatggaaaaagctgtcgcggaaaacctgggtgaagaaaactttaactccgcgttccgccagcagtttcatgttggtgccgttcttttccagcgccgccacatccgaaaccggaatgccatatatccgctccatcaccatcatgttctggctacagtaatcggagtacacctccgggatatacagcatgggactattttcaaaattgcgacgtaactgaatcgcgttggccgattcccgcagcagattcagctcatcgatcagcgttttctcatactcacgcaccacttccgtcgggcgcagacgacgcccatccggcaacaggcgtggtacccagcgagcaaggcgataaatcagtttcaggtctgcctgaattaccggcaaaatatccgggcgaatgaccttaataaccacttctttaccgtttgatttcaatcgcgcggtatgtacctgggcgattgacgccgacgctaaaggctggatatcaaagtcgtcaaaccaggcttcgacaggtagcccccccatcgcctcttcaatctgggctttcgccagccgaccatcgaatggcgcgactttatcctggagcaaagcgagctgatcggcgatttgcggcgggaacaggtcacggcgcgtggagagcatctgaccaaatttgatccagaccggtcccagctcttgcaacgccagtcttaatcgttcacccagcaatttatctttatgccggtttggcatccagaacagcgaatagcgccataatcggagtggcagtgtaagacgcattcgggggatgagttcatcaaggccgtagcttagaaacgtgcggatgatgaaatataggcgccgtacttcacctggcgtcatttggcccccagtttttccagccgtgtggtcagagaatctacggcgcgctcaacagccgcggtttcttcggcaaaccatgcgacttccagcgggccaggcgccatacgccactcttcagtgatcgcttcagcggcataacgctgctggcgttgaaacccgtggcgcaggaatttagccccgccacgcacgaccttaccgatactttccgccgcaatatcacccgtgtatggcgccaacagctccgcaggatcgaattcggcgagatcggcgagcgccacaaaattttgcacgacctgaatatcgccctgcacttccagttcgccgctgcgaataagcgcggccaactgctgacgatcgcgtagttttggcaaaacgctagcttgagtgattaccgtacagtccgcttcgccttcccatgcccccagcacatcaacctggcgttcactgaataccaggactaatggcgtcgaaaatccctttagtttcacacacagtacttttccctgtaagcgcgttctggctgatttcagcgctggcgaacgatacagaaacgtattgaggagaccttcaattcctgcggtcactaagggtttaaaaggcattccaccctcctagaatttataaccacggtgcaatgccacaacgcccgccgtcagattgtaataatccacgctctcaaatccggcgtcctgcatcatggcttttaaggtatcctgatcgggatgcatacggatggattccgcgagataccgatagctatccgcatcgttcgcgaccatcgagccaatacgcggtaaaatatggaaagaataggcgtcatacgctttactcagcggctcaatgataggcttggaaaattcaagcaccagtaaacgtccgccgggtttcaacacacggaacattgaccgcagcgctttttctttttccgttacattgcgcaaaccaaacgaaatggtaatgcaatcaaacgtattatcagggaaaggcagagcttcggcattcgcctgcacatactctacgttgccgatcacgccgatattacgcagcttctcacgccccattttgagcatagaatcattaatatccgccaggataactttgccagtttccccgaccatacgtgaaaatttcgcggtaagatcgcccgtcccgcccgctaaatcgagaacggtttgtccacgacgcacgccactgcaatcaatggtgaagcgcttccacaaacgatgaatgccaaatgacattaaatcattcatcacatcgtactttgacgccacagaatgaaaaacgtgggccaccatgtcagctttctgctctttagcgacggtctgaaagccaaagtgcgtcgtttcttgtgaatcttccaccatctcagtgcctgcttatcgataaaaatgttcaagaagtgtaacagattgggccaatttgccctactctgcgccaggactaaactactccgtatgggttaacttaactgctgcttcacccgttcatcattgggataatgttcatcctgccgcccttcagggatcgatcgtaaacgatattcttcatcttgcgtaacggcctgttccgctaaatccggattaatctcgcgtttgatttccacgcctagcccccggaaggcctccgcctgcgccaaaacgttgccacgccccgacgcaagttttttcatcgcctggcggtagttatcctgcgctttatccagactctgaccgatcgctgacatatcatcaacgaacaaccgcattttatcgtagagcttactggctctgtctgcgatgtgctgcgcattgcggctctggtgttcatagcgccacaggttggcgattgtccgtaacgccaccagcagcgtcgtggggcttaccagcataatgttatttttcagcgcctcggttatcagttcgggctgtttatctaacgccagcaggaaagcgggttctacggggataaacatcagaacatagtccagcgagcggaggccgggaagctgctggtagtctttacgccccagtaagcgaatatgattgcgcaccgaggcgatgtgctcttgtaaagcggcctcgcgcgtatagtcatcttcagcgttaaagtaacgctcgtaggcgactaacgtcattttagcgtcgatgaccacatctttgccctgcggcaagcggacgatgacatccggctgcatccgcgagcgcgcatcgttctcaatactgacctgggtttcgtattcgtagccttcacgcagtccggatgcctccagcacccgcgccagcacaacttcgccccagtttccttgtgccttattgtcccctttcagggcgcgcgtcaggttgatcgcttcctgcgccatttgcgcgttaagctgctgcaaattacgaatttcgtgcgccagcgtatgccgctcctgcgcttctttgccaaaactctcctgaacctggcggcgaaaaccgtccagttgctcacgcagcggcgtcagcaggctattcaggctttgtcggttttgttcgtctacgcgacgattactgtgttcaaagatacggttcgccagattttcaaactgctcgcttaaacgctgttcgctgttgatcatctgacggattttgtcttccgcgtgttgttgagtcgcttccagacgagtcgtgacttcacgcagatcggcttccagagaggtattaatactgtgcaggctacgcagttcgttattaagtaactcgcattcactgcgccagtgcgcttcttgcgctaattgctgccgggccgcgctaagttcaatatccagctcacgccgttcttcgataagatcggcgcggatttgatcggcgtgcgctttcgtcgccagccagccaatcaccgccccagccgccagcgccacgacggcgcttatcataagagtaatatccacaacacctctcctggaaccacactgtcctgcacaaaatagaattgtgctgtataaacgtccagtttaaaagggatttcctgcgaggcgccacgcaaaaagaaaaggccgaacgcgtcggcctttgcaaaagagaggagaattacagcagacgacgggccgcttccacgacaattttcaccgcgtggctttcagtttgtttcatcgtttccgcattcggaatctcttgttgggtacggttaacgataacgcccgccaccatacctgcgcgtaaaccctggcttgcgcacatggttaacagcgtagcggattccatttcgtagttcatcacgcccattgcctgccactcttccatagagcctttgaagcgacgaacaacgcggccagaataggtgtcgtaacgttcctgacccagatagaaagtgtcggaagaggcggttacgccaacgtgagtcgtggcgccaatcgatttcgcggcttcaaccagcgcggtggtgcaggcaaagtcggcaaccgccgggaattccatcggcgcaaaatgcaagcttgccccatccagacgtacggatgcggtcgttaccagaacgtcgccgacgttgatgtgcggctgaatagcccccgtggtgccgatacgcaagaaggtacgaatacccagttgcgccagttcttccacggcaatagaggtagacgggccgccgataccggtagagcaaacgataactgctttaccatccagctcagcgcgccaggaggtgaattcgcggtgagatgccagcttaaccggcttatccatcagcgcggcgatcttttccacacgctcaggatcgccagggacgatggcgagctgggccccttgtaaatcgtttttggtgaggccgagatgaaaaacatcagacttggacatataaaactcctctgtgaatcgggtttgtcagaagaagcaaaaagacactttacctaaggcataaagatattttcgtgacagccatcactatggcgtaaaacaattgcactcgtttaccattaaaaagtgatgtgcatcacaataaataatcaatatcgccaagcattgcacaaaagatagccgctttaaggcaatgtggtttgttacacactgtctatagttaagattgcgctattttttaagggtacggagaataccatgacaacgacacatccatccggctttgcacctgcagcttccccacttgcccctacgatgattcatacacctgatggggccattagcgcggggataacgtcgatcccctctcagggcgacgatatgccagcctattacgccagaccaaaggcaagcgacggcgcgctgcctgtggtcattgtggtacaggaaatttttggcgtacatgaacacattcgcgatatttgccgacgactggcgctggaaggctatctcgctatcgcgccggagctctatttccgcgaaggcgaccccaatgatttcgccgatatacccacattattgagcgggctggtggctaaagtacccgattcgcaagtccttgccgacctggatcacgtcgccagttgggcttcgcgcaacggcggggatgcgcatcggctgatgatcaccggtttttgttggggaggccggattacctggctatacgccgcgcacaacccacagttaaaagcagcggtagcgtggtacggcaagctggtgggcgacacgtcactcaattcgccgaagcatcccgttgatatcgccaccgatcttaacgcgccggtactgggtttatacggcgggcaggataccagtattccacaggagagcgtggaaaccatgcgtcaggcgctacgcgccgctaatgcgaaggcggaaatcgtggtctatcccgatgcagggcacgcgtttaatgccgattatcgtccgggctaccacgaagcctcagcgaaagacggctggcaaagaatgttggaatggttcgcgcagtacggtgggaaaaaaggctaaccacagcgcattacgatgtttgttgggcctacgagaccggagtcggtgtaggctcaacaaatcgtcatcgccacgttagctatgctttaccacagcatttttatattttttgccgctgccgcagggacagagatggttacgactgacggctcctgtgtctttacgcgcgtcctgcgccagccagcgcatgatcgatgccatcggatagccttgcgccagcagctcccgccagacattcatatacggcgtaacgtgctggaaaaaatgtttatagcccgtacacaagtaattatgcgcaggatgaccggacggcgagacggcaaagcgatgcttcggacagccgccatgacacgcaaagcggtagtcacagcgacgacaatcggcggtcagggtctcccgcttggcctcgccaaacgcaatagcccgctcgctattatttaaggttttgatgctgtgctggtggatattccccagcagatgctccgggtagacaaagtggtcacagttgtagagatcgccgttcgactccaacgcgaaggcatgtccacaagtctcggaatgtacacacagtaccggctgctgcgccgtccaggcggctaacgccacgtcaaacatctgcacatagacgcggtctacgtcgcgacgaacccagatatcaaagatctggttgagaaattcgccatattgccacgacggtaccgtccatggcgccagctttgccgcgctttcgccgggcatcaccagattaagtaccgatgagttatcggtgctcattcgctctaccagcgggataaactgaataaaacgcgatcccgccgccagaagaaattcgtagacgtctgctgcatgaccgacgttatgttttcccacgacggttaaggtattaaagtcaacatggtgcgctttaagccgcgccatggctgcgacgacctgttcatgagttccttttccagcgcgattaagccgatagtggttgtgtaacgacgccggaccgtcgatagagagaccgatgagaaaatgctgttcagcgaaaaagcgcgcccactcgtcattcaccaggatgccgttcgtctgtaacgcatgagtgatttttcgcccatcgccgtacttttcacacaatgcgacaacccggcggaaaaatggcagccccatcatggtcggttcgccgcactgccaggcaaagtcaatgcggtcgccactctgcgcggcaatatgctggcgtataaactgttccagcgtctcgtccgacattcgccagtttttattgcgttccgggtacagcgcctctttttcaagatagaagcaatatgtgcaatcaatattgcagatcgcgccgccgggtttggccattacgtgacaacctgctaccgccatgtcagacatctccgttaaaaaataaggttcaccagcgccatgagacaatgcgacgtttatcgtcgccagggaacataacagaatggaaaacctcgttttgtgctatgagagcgctgggcgatcatgacaggaaaaacgatctgcgaggcaataaaatccgccgcgctgcttccggggacgctatccgcctggttgtcattcatacggagaacctttttattatcaagatcgccaaatagccagatcctgaaaaagacagcgcggaaaataagaaaaagggaaatgagaagaaagaggcgctgttaatcaggtcagacacgggcgctacccgtcaaagggtagcgccgcattgctgccggataaacgcagcggtcaggatgggttatttcgcctgacgcagattgtgcgccgctttgaccatgttcgctaacgccgcgcgggtttccggccaaccgcgagttttcagaccgcagtccggattcacccacaggcgttgtgccggaatacgttgtgccgccttcttcagcagggcttcaatccactcgacgctcggcacgttcggcgagtgaatatcgtacacgcccggcccgatttcgttcgggtagtcgaacgcttcgaacgactccagcaactccatatccgagcgggaggtctcaatggtgatcacatccgcgtccagcgcggcgatcgaatccataatgtcgttgaactcgcagtaacacatgtgggtgtggatctgggtttcatccttcgccaccgccgcgttgatgcggaaggcttccacaccccattccagataggcgtcccagtcgctgcgacgcagcggtaaaccttcacgcagcgccggttcgtcaatctgaataatcccgatccccgccgcctccagatccgcgacttcatcacgcagcgccagcgcaatctgtttcgcaatcgtttcgcgggtcacgtcttcgcgggggaatgaccagcaaagaatagtcaccgggccggtcaacatcccttttaccggcttgtcggtcagcgactgggcatatttcgcccactccacggtaatcggtgccggacggctgatatcgccaatcactaccggcggtttcacacagcgggagccatagctttgcacccaaccattctgggtaaagacgaagccgtccagatgctcgccgaagtattccaccatgtcgtttcgctcggcttcgccgtgtaccagcacatccagccctaaacgctcctgctcgatgatagcctgtttgatatgttcggcgatgccggtgcggtagttgttcgcgtcgaggttgccctttttgaagtccagacgcaggccgcgaatttccgtggtttgcggaaacgaaccgatagtcgtcgtcggccaggcgggaagtttaaagcgggcgcgttgcgcttcagcgcgcacctcatacggattctcacgctggctgtcctgcgcggtgatcgccgccaggcgtttttctactgcggcattatgtacgcgatgggagcgacgacgagcctgaatcggtacgctccattcctcaagcgccgccgtttcgccgctgttcagcgcatcgcgcagcaacgccagttcaccgcatttttgcagcgcaaaggcaaaccagctttttacttccgtatccagacgcgtttcgacgctgagatcgatcgggctgtgcagtaaagagcaggaggatgctacccacagcgcgcgtttgcccacaatggcgttaatctgcgcgtatttttcggtcaaatcggcgcgccagacattacgcccgttaatcaagcctgcggagagcagccagtcgaccggcagacgttgatgcagttccactacatcatctttgccatgaatgaggtcaacatgtagcccctgtaccggtagcacgataatagtgtccaggtttggcgtcacgccttcaaaataggtcgtcagcaacagcttcacctggccggcgagcgcgtcgtaagccggtttgaaggcatccagccacgcctgcggcagttccagcaccagtgctggctcatcaatttggacccactcaacaccacgcttcgccagctcagccagcacgtgctgatacaccggcaaaatgtctttcagcaacgtcaggcggtcaaacggctcgcctttcactttacccagccacagatacgtgacaggccccagcagtacgggtttgatcttatgccccagcgccagcgcttcgtccacttcctccagcaactgtgtccaggtaagcctgaactgctggcctttgctgaactccggtactatgtagtgatagttagtattaaaccatttggtcatttccgctgccgccgccggttcgccggttggcgcgcgaccacggccaatgcggaacagagtgtcgatgtccacggaaccgtcgttgttctgatgacgagccggcacattgcctaacagcaggctggtggtcagaacatggtcgtaccaggcaaagtcgcctaccggtaacaggtcaatacccgcttgtttctgctgctcccagtgacgcgcgcgcagttcgcggcccaccgccagtaacgcttcacgcgttgtgttccccgcccagtagctctcttgcgcttttttcaactcgcgacgcaggccaacgcgaggaaaaccgagggtatgagtcaatattgtcattttacttcctctcttattttattgaatctgaaagtaaaactctaaatagttcggcttgcaggaaggcggcgacacagcgcatccccaggagcttactgaagtaagtgactggggtaagcaaggaagccaacgcatctgcaagtcgaaatatgacgagttttagacgtctggatgtttacacatccataatgtaaaggtactgtatattcctcaagcgcaatttgttcatggcgaagtgaaggactttcatgatcgaaattaaacatctgaaaacactccaggcattgcggaatagtggatcgctggctgctgctgctgcggtgctgcaccagactcaatccgctctgtctcatcagttcagcgatctggaacaacgccttggcttccgcctgttcgtgcgtaaaagccagccgctgcgctttacgccgcagggggaagttctgctgcaactggcaaaccaggtgctgccgcaaatcagccgtgcgctgcaggcgtgcaacgaaccgcagcaaactcgtctgcgcatcgctattgaatgtcatagctgtattcagtggctgaccccggcgctggaaaacttccgtgcaagctggccgcaggtagaaatggatttcacatccggcgtcacttttgatccgcaaccggccttgcaacaaggcgagctggatttggtgatgacgtcggatattttgccgcgcagcgggctgcattattcgccgatgtttgattttgaagtccgactggtgctggcgcccgaccatccgctggccagcaaaacgcagattacgccggaagatttagccagcgaaacgctgttgatttacccggtgcagcgcagccggctggatgtctggcgacatttcctgcaaccggcgggtatcagtccgctgctgaaaagcgtggataatacgctactgctgattcagatggtggcggccagaatgggtattgccgccctgccgcactgggtggtggaaagcgttgagcgccagggtctggtggtgaccaaaaccctgggcgatggtctgtggagccgcctgtatgccgccgtgcgcgacggcgaccagcgtcaggcggtgaccgaggcgtttattcgctcgacgcgggatcacgcctgcgatcatctgccgtttgtgcggagcgcggagcgacccattttcgatgcacccacagcgaagccaggatcacagccgcgcctgtaataaagcttggccagtggggctgctgatgccagatggcaagattaaccagcagtcctgcgggaacatgcatattattcatgatacccagcgtcccggcgtctacctgggtagcgccatagttccacataaagtagccaatgccggacgccaccacgccgagaaacaccagaatgctccattgcagcgtggtttccggcagcttttgcgcgttccccaacagcgaccacgccaccgccgccaccaaaaacgcccccagatagaaccacgcaaaggcgttgtgctgcggcatgggacgggtctccatcagacgtttataccccaccattccgatagcgaaactgatattagaaagctgcaccaggagcaaaccgacccaaaaatggtcggtcacgcgatcgtagcgaataatcccggcgccaatcaccgccagcaacgcgctaaatgcatagccccagcgcaaacgacgctgactcatcacatcgtaaatcagcgtgatatagagcggcgtcaaaacggtaaacagcagcagttcggatacggtcaggtagaggtaagcatggaagctcaacatatacatgatgccaagctgcatcgcccccaccagcatatacaggctgatggtttttaggttgtgcccgcgagtacgcaaaaacggcagaaaaacgagcgccgccagcccaacgcgtatcagcaccgcgaaatagctatcgacatgcccggcaagatactcgccaaatagactaaaggagaaagcccacaggatagtggtgatgatgagtagcgccacaatggatgtctcttaaaacagggaacacccattgtagcggagagtgaggttgacaactggtcaactaacaaacaatcacatcagcgtaagaaaagatcgcgcaggtaatgcggcacggcgttatccgcgttgatgccgatcacctcaagttcgggatacaggtctttcagacgctggtgcgcattgcccatgatgcagcctttgcccgccatcgtgagcatttcagcgtcgttcattccgtcgccaaaggcgatacactctttcaggctgtaccccatcgcctgagcgaccgcttccagcgcatgacttttcgacactccgcccgccatcacttccagacaggttagcgtagagaagctcacgtttacccgatcgccccagcgcgcgttaatcgcctgctccagcggcaacaacttttcatgagtgtcgctggtgaaaaacactttgctgacgccctccggctccagcagcgcaggctcaaacagcgaatagttaaataccgcctctttgaaaaaacgcatttcatcggggcgatgacgattcataaaccattcgtcgtcgcgataaacgttagtcacgatgtccgggttcgcattcaccacgccgaacaggtcgctggcaatgtcgctgtccagattatgcgtaaaaaccaaattcccgtcggtatcgtgcactcgcgcgccgttggaggtgatcatgtaagacttgatttcaagattatcgcggatttgccctacatcgacatgatgacgaccagtggcaaagacaaaatggatgccgcgtgcggtcaacagcttcagagtctctttggcataaggggacaacgtatggtcgggggagagcagcgtgccatctaaatcagacgcaacaacctgatacataataaaatttaacctctaagcaaagcgatttccgctggataaattaggcttgttgaaaaattcaacaatggcgttaagcgcgactgagcgcatggcgtccttttcaaaaaggatctcatggtacgcgcctttgataaccagcggttttcccccttcacaagggtatcccgccgcggcgcgaatttcacaaaaacgatcgtgggtgcggttatccactacccgctcttcttccgcctgaatcagtagcgtaggcgtcgtgtcatcgctcgccccagccagtacctgctcacccgccagaatgccttcgcgtacccaatgccaggtggggccgccaacgcgcagctgcggctcgtcggcataaaatcgtaagttgcgctgataacgctggcggctgtgggtcagcgcattcatcccaaacggcaacgcccgccactgaccggtaccaatagcgtaatcttcacggatacgctgatgcccttcggcccagtcgagaatatggcgcaccataaaggaaggcaagcgtatcacaataccaaacatcggcgcggtgagcgcaatagcgtcgcaccgcacacgatggcgttgcaggaacagggtggctatcgcgccccccattgagtgcgccaggatataacgcttacgccacgaccccggctcaatttcctgctgccagaacgccgctaagtcctcaacataatcgttaaaatgatcgacatgaccccgatgcgggtccgataacatccgcccggagcgcccttgaccacggtggtcgatgatgaagatatcaaaaccgagatgaaaaaggtcatacgccagttcagcgtattttacataactctcaatgcggccaggacaaatgacgatcgtccgatcgttggagtcattccgaaaacggacaaagcgcaccggaatgttatccacgccgataaactccgcctcttcccgctgacgccaaaaatcggtcagcggccccatagcaaaagcggcaaacgcattttctcttgtttcccagtcattttgctgctgaaacatcgggttttcggcctcgtttaccaggtaaaatcgttttttgcgtcgtgcctgacacaacacagcggcagtagcgtattgtggcacaaaaacagacaaccaaggagtttcgcatgacctttgaatggtggttcgcctatctactgacctcaactctgttgagtctttctccgggttcaggcgccatcaataccatgacgacgtctatcaaccatggatatcgtggcgcagcggcttctatcgccgggctccagaccgggctggggatacatatcgtactggtgggcgtcggactgggtacgctcttttcgcgctcgctcatcgcttttgaaattctgaaatgggctggcgcggcttatcttatctggctgggtatccagcaatggcgcgccgcaggcgctatcgatctgcatactctcgcccagacgcaatcgcggggtcggctgttcaaacgggcgatatttgtcaatctaaccaatcccaaaagtattgtctttcttgccgccctgtttccgcaattcatcatgccgcagcaaccgcaactggcgcagtacctcattctcggcgtcaccacgattgtggtggatatgattgtgatgaccggttacgccacgctggcgcagcgcattgccgcctggattaaaggaccaaagcagatgaaggcgctgaataaagcgtttggttcgttgtttatgctggtaggcgcgctcctggcgtcggcaagacacgcgtgatagtcgtgccggatgatgtttatccggcccggaggtaaattaacgcgaaataatcaggtgaataccaaagcccgcaaacagagcgccggcaaagccatcaatccatttcgccagacgctgatagccacggcgcattttcggcagcgcgaacaggctggcgactacggtaaaccaggccagcgtttccagggtaattaacgcgaaaataccccagcgcgccgcagcgccgacgttatcgccgacaaacagtgaaaaaacggaaccaaaatagataatcgctttcggattcgacagattggtcagcagccctttgagaaaactgcgcccgctctgcgccagttcaatgtgcggagaagacgccgccgcatcctgttttttcagcgcgccgcgcagcatctgatagcccatccagcacaggtacaggccgccgcctaccataatgatcgtatgcagccaggccattttttcgatgatgagatgcaggccaagcagcgccacgcccgcccataccatcacgccgcaggtgatgcccagtacgcccatcatcgcttctttacgcgaacggctgacggcagtttgagacacgaagaaaaaatcggggccagggctcattagcgcaacgatgtgcaccattgccacggtgaaaaatagcatcaacataaaaatggctcgcggggaaatagttcagtgagtcaccatcctggcacttttttgccgggctgactactcttcgtcatcaccatcgacatgcgcgcggatgagcgccatgaattctttcccgaagcgctccagtttgcgcatcccaaccccgttaacgcttaacatctcgctggcggaaaccggcatctgttccgccatttctatcaacgtggcgtcgttaaagaccacatacggcgggatattctcttcatcagcgatagctttacgcagcttgcgcaacttagcgaacaatttgcgatcgtaattaccgccgaacgatttctgcatcacgcggggtttgagggcgacaatgcgcggcaccgcaagctttagcggaacgtctccacggagtaccggacgcgcggcatccgtcaactgtaatgcggagtgctgcgcaatattttgcattaccagccccagatgaatgagctggcgaatcacgctcacccagtgctcatggctcttttcgcgtcccatgccataaaccttgagtttgtcatgaccgaaatcgcggatgcgttggttattcgcgccgcggatcacctcgacaacgtagcccatgccaaaacgctggttaacccgaccaatggtagaaagcgcaatctgggcatcgtttaagccatcatattgtttggacggatcgagacagatatcgcagttgccgcacggttcttgtcggccttcgccaaagtaattaagcaataccaggcggcggcaggtttgcgcttcggcaaaagcgcccatcgcattcagcttatgccgttcaatatcctgaagctgtccggctggtttctcttccagacaacgacgtagccaggccatatcagccggatcgtaaaatagcatggcttccgcaggcagtccgtcgcgcccggcgcggcccgtttcctgatagtaggattcaatattacgcgggatatcgaaatgcacgacgaaacgtacgttaggtttgtttatgcccattccaaaagcgacggtcgccaccacgatttgcagatcgtcgcgctgaaatttttcctgcacatcggcgcgaatagcgttttccagccccgcatgataggccgccgcgctaatgccgcgactttgcaagcgcgcggcggtatcttccactttcgcccgactgttgcagtagatgatacccgatttgccgcgttgctcctgaacatagcgcattagctggtcgagcggcttaaacttctccatcagcatgtagcggatattcggtcggtcaaagctactgatctggattaacggatcgttaagcccaagcagacgaataatatcctggcgcgtggtgtcgtcggcggtggcggtcaatgccataaacggcaaagcgggaaaacgctggcgaagctgaccgagagccgcatattccggacggaaatcatgtccccattgcgagatacagtgcgcttcatccaccgccagcaataccggattccagtgcgccagatgatcaagaaagttgtccagcatcaggcgttccggcgcaatatacagcagacgaatctgtccggtacggcaccccgccatcacctcaagctgctgctcgcggctttgagtggagttcagacaggccgccgccaccccgttcgccagtagctgatcgacctggtctttcatcaacgagatcaggggcgaaacgacgacggtcaatccgtccagcaacaacgcggggatttgatagcacagagatttgccgccgccggtgggcatgacgaccagacagtcgcgaccggagagcgcagtatcaataatcgcttcctggcccgggcgaaactgttggtagccaaaggtttcctgcaaaacctgtttggcccctgattccagattcaacacttccgcctgcgccacattaaccccgttcaccataaatcaaaacaggcgctattttcagcgcctgcgagagaaactgcaatgtttaaaacacaatccaatcagaagatatcgttaagcatcacgccgacgccgacacgtgtctgattaaaattatagtcgatcagcgattcgccatagccgctatacacctgggtataaagccggacatgtttagtgaccggatagcttaatccaacttccgcgccgccgtagcctgtattccagttgtactggcctttggcgcttaataccgcctcgcccaggtgataaccgattttaagctggtaataacccatatatttggtgatgtccggattatcgtcggtactgccaatcacgtaccatggtttgacctctaccagccagttaccgttttcggccatcagacgggtatacagacggttccagctacgcgaggtggggtccgaacgtccgttagagtcatggttgtagcccatctctacgtcgcgcagcgtccagccggcaaagcgataatcggtagcaaaaccaagaaaaagctgcggttcgtagttggtttcgcgaaacggcgaagactctttactgttggaaagctgccaccaggatttctgcgtataggaagcgcccagtaccgagttcggccccagtattccgcgccacagcggaaacgccaggctcaactgaaatttcacttcatctttacgtgcgttttcagaccagttgtaggtacttatggcctctttgttcagatcgctggtgttcgtgtagatcaagtagttcgtgtcataagggtaaagcgtaaaagggttatcatgctcctgtagcatgttagcgatgatacttccccgtactgcaggcgcatcatgaacctcttttatcgtagcttcttgtgcatatgccgctaatggcagtagcgtggctggcaacaaccctctcaaaatcgcccgcattcttgacgttctcctgacgaagtattttcagcttgaatcattctctgccaaccatttttacatatttacacacatagccgttagttatcccttcttaaagtagaaaacaacaattaagaagcataatatcaacatttcattaaccaatggagtatcaggaatctatgtccgctgtacttaccgctgaacaagctctgaaattagtgggtgaaatgtttgtctaccacatgccgtttaatcgggcgttagggctggagctggaacgctatgaaaaagcgttcgcccaactggccttcaacaaccagccgatgatggtcggcaactgggcgcaaagcattttacacggcggcgtgatcgcctctgcgctggatgtcgccgccggactggtatgcgtcggcagcacgctaactcgccacgaaaccatcagcgaagatgaactacgccagcgcctgtcgcggatgggaacgattgacctgcgcgtcgattacctgcgtccgggcagaggcaaccgctttacggccaccagtagcctgctgcgcgcagggaataaagtggccgtcgcccgcgtggaattacacaatgaagatcagctgtacatcgccagcgccaccgctacttatatggtgggataaaagcaggtaaactgttgttacacttcagatacgagttttccggatggacgcaaaacaaacacggcagggcgtattactcgctcttgccgcctattttatttgggggatcgcccccgcatatttcaagctgatctattacgttcccgcagatgagatcctgacgcaccgcgtgatttggtcatttttctttatggtggcgctgcttagcgtcagccggcagtggcgacaggttaagcgtttactgaaaacgccaaagaagattttcctgctggccctgtccgccgtactggtcggcggtaactggctattgttcatttgggcggtaaataatcaccatatgctggaggccagcctgggttatttcattaatccgctggttaacatcttgctggggatgatttttcttggcgaacgcttccgtcgaatgcagtggctggcggtgattctggcggtgtgcggcgtgctggtgcaactctggacctttggctcgctgccgattatcgcgctggggctggcgtttagttttgcgttttacggcctggtgcgtaagaagatcgccgttgaagcgcagacgggtatgctggtcgaaacgctatggctgttgccggtcgccgcgatttatctgtttagcatcgccgatagcgccaccagccatatggggcaaaacgcactatcgttgaacttgctgttaatggcggcgggtgtggtcactacgattccgctgctgtgctttaccggagcggctacgcgtctgcgtctttctacactgggctttttccagtatatcggcccaacgctgatgtttttactggcggtgacgttttatggcgaagtgccgggcgcggataagatggtgacatttgcgtttatctgggtcgcgctggcgattttcgtgatggatgcgatttatacgcagcgtaaaaaataacgcgactattattctaaatataatctgaaaaaatatgcctccccttgtaaggggggtagcatattgtcatgctaacgacgtaacccaacatatggatgtgaaattaatgttaagtgtttttattccttcatctgagagatgtgtttccagatgtcgttatttattatcattcgcgctaataaatataatattttccattttggttggggttttattatatttaagctttgtgatactggcaattttattcacaattttactacattatctcgtcattaatttaaactgtcagcgattcagagacagtgactttgaatatataaaattctatgtatggggtacgcttgtaatctatattgcctccttcgtgataatggttgctgaagatttcgcttgcgatggctttggtatgcctctttttctaatctggtattttgcaaccttttctctgctacttctggcccccccggattcgaattcactcaacaagtaatttaatggagtttacatggacaaggattatattaatgatggttcgttatctgaaaaatggaaataccgtttttcattttacgatcaacatggtttccctggattttggaaagtaagcccagaatataaacaggcatttaaagcattaaagccccgacaacggttgactattcaaataaactttattgcctttttcttctcatggatttatttgtttgtactgggtctgtggaaaaaagcaattatagttattttattagggatcgttgcaatatttattggagcattaatcggcgttaacatacttggacttgttgtcgcagcttatgtcggcgtcaatacaaataagtggttctatgaaaaagaggttaaaggtatcaatacttggagcctgtaacttttcagggtggttcagccgcagctgaatcaccctggccttaatgtcttacagccagttcttgcgcttaaagtacagatacggcgcaagccccgccagaatcataaagataatcgcgcctggataaccaaagctccacttcagttccggcataaactcgaagttcatcccatagctggaagcgaccagcgtcggcggcaggaacaccacggaaaccaccgagaagattttgataatgcggttctgttcaatgttgatgaaacccatcgccgcctgcatcaggaagttcaccttctggaacagcgattcattgtgcggtagcagagattcgatatcgcgcaggatctcacgcgcctgctccagctgtccgcccggtaagcgcgccttgcgcaccaggaagttcagcgcgcgctgggtatccatcagacacaggcgtaccttccagccgatatcttccagttccgccagcgtggagagcgcttcgtcgtattcatcgccctgatgcccttccataatgacgcggctcagtttttccagatcgctgtagatgttttcgatttcatccgccaactgttcaattttggtttcgaacagatcgagtagtagttcgtaagcattaccatcgaccatcgcctggctgcgggcgcgcatacgatacaaacggaaggcgggcagttcgcgttcacgcagcgtaaacagacggccatcgcgaatagtgaatgccaccgtagagttaccggcatgatcttccgcatcttcgaagaagaagaaggagtggatatgcagtccgtcttcgtcttcaaagaagcgcgcggatgcttcgatatcttccagttcaggacgcgtcgccagactctggcccagctcagattgtacgcgcaatcgctcgtcgtcgtccggttcgaccaaatcgacccatacggcatcaatcaggctttgtgactcctcgacttccagccgggtcagtcggtttttttccagttgaaatgcgctcagcatgaccgggactcccaatgcgtaaaaatatcggacagttcagatgggcacacagaaacaaattgggtttcagaccattaaacagcctgactcaacgcgacgggaaaaaatgaaaggtcgctgacaaccgctaaggctatcagcaaaaagggatagccttaggagttgatcctggatgacaggataatgagccagtatctactgggtgtgtccaaggcgaatgtcctcttagcgtaatcgtgggcgcatgttacgccagcaaaaatttgccgtcaacacgcaacgaaacgcgaaaaagcaataatttccccttatgcagaaaggttagcagagtgagagtatttatctatgatttcagaatattaacatcaatatatcgccggatggcagcttcgccttatccggcctacaaatcaaaatgttagccagcgcgtaggccggataagaggtgccatccggcaatatgagagccggtcaaaccgtttccagcttcgcatacgcggcaaccagccatttgatcccttgcccctgaaaagccacctgcaaccggctatgttcgccgctgccctccaggttgacaatagttccctcgccgaacttcgcatggcgcacgcgttggccgagtttgtagcctgtgtcgttttccgccagcggcgttcccattcgttgatggctcaccggacgactgacggtggcgcgcagacggacctcttccacgcactcctccggcaactcgccgatgaaacgcgacgggcgatgataaacctctttaccatacagacggcgagtttcggcataggttagcgtcagtttctgcatggcacgggtaacgccgacgtaggccagacgacgctcctcttccaaacgccagccctcatccagcgacatctggctggggaacatcccctcttccatcccgacgataaacacctgcgggaactccagccctttggccgagtgcagcgtcatcagctgtaccgcatcctgccaggtatccgcctgcccctcgcccgcttccagcgccgcgtgagagaggaaggcctgcaatggcattaaatcttcatcttcgtcgttgtagctgaactgccgcgttgccgtcaccagttcctctaagttttcgatgcgcgtctggcctttctcgcctttttcttgctcatacatggtgcgcaggccggaatctttgatcacccggtcagtctgcacatgcagcggcatgtcggcggtttcctgcgccagggcgtcgatcagttccataaagcgttgcagcgcgctggccgcacgcccggccagggctttttcctgtaacaattcacggcacgcctgccacaatgttagctggcgatcgcgcgaggtctggcgcaccacgtccagcgtgcggtcgccgataccgcgcgttggggtattcaccacgcgttcaaaggcggcatcatcgttgcgattggcaatcaaacgcagataagagagcgcatctttgatctcctggcgttcgaagaagcgcataccgccgtaaatgcggtacggcatactggcctgtaataacgcttcttccagcacgcgcgactgggcgttgctgcgataaaggatggcgcattgcgcaagcgcgccgccgttgtcctgccaggttttgatacgattaaccacaaagcgagcttcatccagttcgttgaaagcgcagtacagcgatatcggttcgccgtcaacgccgtcagtccacagctttttgcccagacgcccgttgttgttttcaatcagggcgttcgccacgctaagaatgttgctggtcgagcggtaattctgctccagacgaatggtctgcgcgccggggaaatcattgaggaagcgctggatgttctctacctgggccccgcgccagccgtagatcgactggtcatcgtcgccgacaatcatcactttaccggtatcgcccgccagcagacgaacccaggcgtactgaatgttgttggtatcctggaattcgtccaccagaatgttagtaaaccgctcgcgatagtgttgcaggatgtgcggcttgttcagccatagttcatgagcgcgcagcagtagctcggcgaaatccaccagaccagcgcgatcgcacgcttcctgataggcctgatacaccttctgccaggtctgttccaccggattgccatagctttggatatggtgcgggcgtagcccttcgtctttctggctattgatgtaccacatcgcctgacgcggcggccactgcttctcatcaagattcatcgccttaatcaggcgtttaagcaaacgcatctgatcttcgctgtcgagaatctggaaatcctgcggcaaattagcgtccatatgatgcgcgcgcagcaggcggtgcgccagaccgtggaacgtccctacccacattccgccctggctggtccccatcaactggccaatacgatggcgcatttccgccgccgctttgttggtaaaggtcaccgccatgatggagtatggcgagttgttttctacgctcagtaaccaggcgatacggtgcaccagcacgcgggttttcccgcttcccgcgcccgccagcaccagcatgttgctacgtggcgcggccaccgcttcgcgctgtttatcattaaggctgtcgagcaggtaagaaacgtccattggcaccgccgcgtaaaaacatgaaaactaaaaacgcccggtggcgcttcgcttaccggggctacttatcgtagggcggataagcatagcgccatccgccagaataactgggaatttatacagaactactggtgattatatcagcgaggtgagagatgccaaccgcgaaatttcgatatgcggcagtaaacggctgtcctgcgtccgcatcaggtcggcattttcaggtttaatccagcaggcctgcatcccacagcgaatagcgccagccacatcggtagtcagatcgtcgccgacatgcaggatctcgccgatcggcacatgcagtttttccgccgccaggaaatacatgtcgctaaacggtttggaacgtccatccgggccggcgcgcagtacaaacttaaagtaatcgccgaggccaaacagttccggctgggcattgccgttagtgatcgccaccagcggccattttttcgcaagctgctgtaacgtctcatgggtagcctgcggaacctcaatctggctgcgccatttggcaaaatgcatcatcgccgcattcgcaccggcaatggactcctgcgccgataatcccgcatcccgcatggcctgctctatcgcgcgatggcgccagcgggtaacgtcatgatagatttccggctccgcttcacgcaccgcctgccgtatccgctgtaaatcgacgttttgaaacgaacgtagcgacgggtgataattttgcataaaagcgagcgcttcctgctcagtacgcaaaatcaccggacggttatcataaagggtatcatccaggtcaaaggtgagcgcggcaatacgccccaaaggccggtaaaaacgcattatttcccccgtttagcgcgcggatgcgccgcgtcgtacactgaagcaagatgttgaaaatcaagatgagtataaatttgggtggtggaaaggttggcatgacccagcagctcttgcacgccgcgcagatcgccgctcgattccagcatatgggtcgcgaacgaatggcgcagcttatgtggatgcacgtggctgtttagcccctgctttatgccccattcggcgaaccgtttttggacattgcgcgcggagatacgcttgccgagcttcgacaggaataacgcctcttcatcgctggcgaacaggccgcgcagatccagccagtgctcaatccacgtcaccgcgttacggccaatcggcaggcgtcgctctttgctgcctttacccattacccacacttctccggtatcgagatcgaggtgctttatatccaggccaaccagttcggataaacgcagccccgcgccgtacatgacctccagcatcgcccggtcacgtacggcgagcggatcgttaagatcgatgtccagcaggcggttaacgtcgtcgacatcaatatttttcggcagatgacgcggcgctttcggtgcggagacgcccttcgccgggttagctttcaattcgccctgactgactaaccagtcaaaaaagcttcgcaatgccgagagacgtagcgccagactggcagggccaagccctttacgccgactgcgcaccgcaaaactgcgcacaatcgcagcgtcacattgttgccagcttttcagcccggtttctccggctaaagcgataatggcatcaagctgacgctggtagttctgcagggtaatggggctaagctggcgctccacgcctaaatagcgcaggaaccgcgagacatccagagaaagcgcgacctccgtcatacgcgtttaatccagcgttccagcagttccggcagcatcagcgcgatctcctgtaaaagctgcgtcccctgccccggctgatagtggtgcgggtcacggctgctgaagagaatcaccccgaggtcgccatcgctgcccatcatcgacatggctaccgaccctacagccttcgcctccggcaagaccaccagcagttccgggccgtttagcgggccaagataatgctgcgactgtcccagtcgttgaatacgcagcggctcgaaggcctgacggtttaaagccagatgcgtatagcgcgatggcgcgccaagacgccaccgatccgggaacaaacgcagcgtcgcgccggcaagccccaaatcgcgcgcccagcggtgaaaccgcatcagcatctcatccagactatccgcggcgaccagacggctttgcagatgcagcaagcgataaaacaggctttcattggcatgagcctgttccatcagcagcgtcatattttcttcaagcacattgatgtgattacgcgcgcgggccatatgccactcaacgagcgaaaccgttccccgcacgggatgtggaacacgcatcgcttcaacggcgtgggcgttacggataaaaaactcagggtggtggcgcaggtaatcgacgaccgctcgatcgtccagttccgtgagcgtttcctgtagttcttcctctggttgcttcataaatggataaatccgtcgtagatatgtgccgccggaccagtcatgtataacggatgacccggacctttccaggcgatatccagccgaccgcccggtaattccacgcgtacttcttcagccagcagcccctgctgaatccccacggcaacggcagcgcacgcgccgctgccgcacgcgcgggtctcccctgcgccgcgttcatagactcgcagccggatatgctcacgtcttacaacctgcataaaaccaatgttggcgcgttccggaaaacgctcatggctttccagaaccggccccagtgtttcaacggccgccgtgtcgacgttatcaacctgaatgacacagtgcggattgcccattgaaaccacgccgcacagtatggtctgttccgccgctcgcataatatacgtcttttccgctttgttggcgcgaaaaggcacctgcgcgggttcaaagtttggctcccccatgttcacccgcaccagttcatcttccgtgacgctcagtaccatccggccattcgcggtactgacccgaatatcgcgtttattggttagccctttcaggcgaacaaatcgcgcgaaacagcgcgcgccattgccgcactgcgagacttcactgccgtcggcgttgaagatgcggtaatgaaagtccaactcaggatcatagggcggctcaaccaccagcagctgatcgaaccctacgcccaagtgtctgtcggatagccgacgaatcagttccggcgaaaaaaagacattctgcgttaccgcgtcgacgaccataaaatcgttgccaaggccatgcattttagagaattgcatcattcactccgttcacgcggggacagaaaactatcctcagtaattgacctgggacgggccatctcccgttgcgcgatcgttcttatcgggcatcgtggactgcgtttgcgaatcgacttttttcgtcggcggcggcgcatttttatcggctggcgggaaataaagcggccctttcaaaccgcagcccgtcaggctgaacagagtcagaagtacagcgagtgtcttaaacacgtttttcattatggattgcctgtaagttcatgctttctattttctatcatcgcaggagaaggagtaaaagcaagcgtttaggggctctttataaaatctgaaaagcggcgcgttgccatgattattgcgcatttacatcaggaaacatgctttgctcatcactttaggtttacgtaccacgtccggatgaccttatgcaatatcgtaatttgttttgccttttttcgctttcacttctgctgcctcccgcttggggatgccggctgagtgaacctccgcacaatgtttatcaacggcaaggcagcggcgtggtttatctccagccagaagaggagaacaatctttcgttgccggaggtgaatttcaaacgcctgcgtcggttacccaattcattgattaacccggcaactcaggatgagtgggacagggaaccgccgctcaccgacctgacgaccgattacgttcataccagtgcgcaggctatcttcccgcgcttttcctactacagcgacggacgcgttattctgtacggtggaaaaatcatgcgtaatccgccggggacgccatcggtagatgtcgcctcatttcgcgcctttggcaaagtcggcgttgataaaaatagtctctatgacgaaggcaaacgaacggatgacaacggcggcgaaaaccgcgttaatttacagtcattgcgtaaggttgaatttagcagccagtggaaaccagacctgttgggcttgacgctgcgcgacgatcgctttctttatgtcgacgggcatcgcctgagcgacccggacagtttcaccgttctggcgcaaaagtcctgggatcagcgcggtaaattttccgccacatttaatccttgtatcgccgtcccctttggtccctgggatacgctggcccgcacacgcaccaaaatcatcatcaacggcgaccaactggacgccgacccagacaccttttccgtggtgcgctggatgcccggttctctattgacctggcgcgataaaaacggcttgcaccgtcacgttctcaaccagaacaatctgaattgggacatgcaaattgaaaaacactgtgatgcgttcaacctgcaggaaaaacgcgtgctgtggcgtaaaggaccgggatgcaaatttgccgaaatccccggccttgacccagaacagtttcatccgctcagtaatgcggtggcgcagtctcaggatcggctttatgccatcaggaaaacggaattcggcgaaaaccaactggatgtcgtcacgctggataacccaaatctggtaatagacaagcgttttaatgccgggcggtatcacggttatttactcactaaaacgcgatccgactttaaggaagaagacggattgcaggtattcgagtcggctggcccgcttattctgatggactatcacgttccggacgagacagaagcgcatctgggcgacagcccacattacaaaaaatggtacgcacgcgacgatcgctatgtttacgcgtttgatggcgctcaactgtggcgctatcccacgcccaatcccaaagctctacgcatgaaatggcaaacaacacactcaggatacggctattgggtggattaccgcatagcccagttagatggcgctctcatggaggatggctcttttatcgccacgggtatcccgcgcgatccttccgtaaaaacagcctatgctaaaaccgatggcacctttgacatcggcaaaacagcggttcgctggcgcaaggttctgtcacctgacggtgagtggggtcgttggcaaaccattcccaacgttgacccgagtcagtttcatctggttaacgatcgcatcgcgcaatataaggaccggctatacattgcgaggctctcaccttttggcgaagaccagttggaaacgctggaactggatagcacagcccccttcctgaaccagaaaattaacgccggaaaagagcacggctactttatgcataatagccagcaggctcaggatattcaggtctttagcatcaatgggccgctaaaagtcaccgagcgttttgcgtatgacaaccgctatgtttatacgtggattggtagccagatttaccgaacagcatccctctgcccggataagacgctcaatttgaatcagaatatgtactccgacaataaagacatcatcatcataacgcaggcgcaggaatgccaaaaatcacgtcgctaagccgttttgcgcgcttgattaaacatttgaaaaacgcccttcggggcgtggggatcggttcatgcatttacgtcattgttgaaagcgttatgcacggcacgataaacggtgttgaagctgccggagtcctgacgataagcgcggtactcggtctgcttagcgctcttttggatatcaaagcaaagccgcgcgcccccttaatcctgttgcattttctcctctgcggcggctgcgtcgcactgatggtggcaatgctgtcggttctgaaccatttcccggttaatgcgtccgtcatacttatcaccagtgcgctatttatcgtcatttatctaccgctgggttttatcctttaccgctcacaacggtaattcgtatcggttccagaagctgacgcttccccttatactggcgctatcactcaatagcgggataaaacaatgaacgacagtgaatttcatcgcctggctgacgccctgtggctcaccattgaagaacgccttgataactgggacggcgacagcgatatcgactgtgaaatcaacggcggcgtgctgaccctcagctttgagaacggcagtaagatcattattaaccgtcaggagccgttgcaccaggtgtggctggcaaccaaacagggcggctatcatttcgatctgaaaggcgacgagtgggtttgcgatcgcagcggcgaaacgttctgggatctgctggagcaggcggcgacgcagcaggcgggtgaaaaggtgagtttccgttaagttttcaattccgcaggagagccagaagaatagcgctttcctgcgtatatttaacgagatatgcggtcgtattaccaaccccggaatgtgaaatacagccaggttgccagaaacaacgcgggccatacactcaaccaaccaacccaaaaaccgtagcgttgccaaaaggttaggttaaatagtgacttctgctcggtaaaaagttgacgtaacgctggtgaccaacgtttttccttgatttcattgctgcaatgattgcatatcgctaaaccaaacttatctctttttctcgcttgagacagaccacatgtacgggtccttttttggcgaataatcaaccatacatcctgattattacaataagggcatgtttcatgtgtgggtagggttgccagaggcagcacatcaatatggtgagtaataacaaaaaacatatatctctaccctattgttccaggtttctggcaacagccattttaaaaatatcctgtaactcatctgaatcataatcgagatcgtttagagagatattcatcacgcgattacttccatgcttattcaataatgacagaaaattattacgcattttctcattagtaattcgctgacaataaagctcaatatctttgacaaaaatggccagcacaggcgtattatcgctaacacgctcaccaacatagtcgatttcatgccagtaaactattggtagcctggttgtgtgtaatgttactccctcctggttcaacgttagctgtggctttcctgaaaaggcggagtaccagtaagcacttgcgcctgctatcatgaggattatgaaaaaaacacacatcatctttagcataatactataatttagaaagaggctcatcataaaaactatagctaacactgaataaaacagagctaattttatttgtcgtttcttattcacgtaaataagaatagggttgtttattgacatataatatccttttataaaaacatccataagaaaccattaaagagcttttgtttctaatatagtttttcaaaacatatttacgaaaacaatgaaggacgcgatagcattttgaacggtctgaatattactacataaattgtataagaaaaaatattatctaaaccttgttccgctcaatgggcattcttcgaatgtaggctggataaggcgcgttagcgccgccatccggcacagtatcgctctaaagccataatcatattgataagaataatgaccacacatgtgagcattaacgcggtaaaaaacaaaaaggcgataccgtacaatccccatcccaggtcatagagagaatggtaattgtcgcaggagatgatcacatccaggccggggcatacttttccccatcgcccccagtaagacgcatcccagagttgcaaactggccatgctggcgcatagcgagagcaggcacccagcggatataaaacagaataacttatttataagaatgaagccgaggctgaccatcgccatgactatccctaacaaaatgaacgcatctgccacctcaaacctcctcctgtaaaccaaatgcggaggtcacggtaacgaagttgggtgaagttaatgtgaagcggtgaacgccggccgggcagcgttgcccggcgcagcacttacgaaaaatactgctgcaatagcggcgcgtcatgatcctggtttgctggcggcacggtgttgataggctgcgtacggaatgggatcacctgcgcgcggccatcggttttcactatctggtagaactgcggcaggttgaagttgataaagctggagccatacgtgaagcgatcgtgcgatgacgaatagaagcgactgacgtcgcgcaccagttcttccttgctaccctcgcagtggtgatacacttccgcccggttactttcatccagaatataaatattaaagcctttctcatcgcccgtttcttcaaagaagaactggataatcccttcgctggcgaagccatccaccactgacggcaatttcacctggttggtttccacctgtaccgacagcccgtgcagcttgttatgcgaaatcgcgccgtagaattcgatagcgttctccagcttctgcaccgagacattcaagcgttcgaagaatagtccccacgtctgcccggaaacccgcagcgccttgaagcgaccggtctcctgacgggtgctggaaagacgtagctcgatacattcggagaccagttgctgcacgcgggtgcgaatcagaccgcgaagatgctgactgtaacagaacacctccacgctatccggcggcgcggcatcctggtgcattttccccagaatcgttttcagcgcttcgatcatcgcctgctcgccgttaaagtgcagagtacgcacttcgttccacgagttgcgatataacaagtcgatactgcctatcagacagttttgctcttcgccaaagctgaaaacgtccagcttacggaagtcaaaatgaaccactttattgcgaaacgccgccgtcgggtcatattcgaggttaacgataatcgccagatggcgaatttcacaggggctgtagagcgctttcggcgttggagcaggcaagcgcagcgggaaatggtgcgaaacatcggcgaccatctcctgcaacttaggcaggtcgacaataccgttgcccttaataaacagatgcgttcgcgacgtcagcaggccgttgaaccacgcccacgcgaccagcttattaagataacggttatattccagcggctgatggctgatgatggaatccatgttcggcgcgcggttgtagagataccagcctgaacggttggcacgtcccggcggcacatggataaaggttaaattcggctcggacagatccggcgatatctgcgggttcaccagcgtgactttacccggcaacgcttcaaacgccgcgtacagcttacgcgtcagtacgccgatatcctgcgggctggcactcacgctgaggttgttgcgccgcgcaaagcgaatcagattacgatagctttgcatcattgcgtcgagcaattcgttgtgggcttcgcgcacctgatcgattttccagtttgcgcgattatcgagcatggtcagacgcgcgtcgtcccatccccactcgctgaccaactggcttaatacttcccgacgccagcctacgcaggcgcgctcgcgacttaatttctcgcacactttcaggtaaaagcagcggcggactaaatccagccgcgtcggatcttcaatcgccgtcaggtattcagtgacccgttccagcatcatgcagtagggatcgagtccaaacgatacgatttcaccgtcatgcagacgttgtttaatatctttcgccagcagacgtgggttggggtattcccatgaataggcttccagcaacagcgttttcagcaccgctttgtacggcgagtcaatgctcttgtatagctgccacaggctggcgccaaagtactcttcggcggagagcgagcttaagccccccaaatccagccattcgtttggcgttaatacgccctgcgcgtagagcgtcatgacatagtcgtcgtaatgctcttcttcgtcgcacggcaccatactccacaggatacgcttcccggccaggcgcacagcggtacgataaaactcatcaagcaacaggatatgctgcgtagaaccacagtcttccccgcccagactgccgctttcgttatggcggaaacggttctcgtcaatcaggaagaagctcacctcaacgccaagcgaggcggcccagctttccagcaggctacacttacgttgcagcaactgacgctcttcgccgtcgagccaggactgatggcacacccagatatccaggtcggacgagcagctctgcccgaccgaggaggtgctgcccatggtgtaaacgccggtaatcggcaactcgcccttcggcggatcctgcggcgtcataccgcggtacagctcaagttcgttcagatagtggcgttgggtttcatcaggcgtgtagaagcaaataccgctgggaacgttaccatcaaggtaacccggcatcagtggatggtgatagtgcaataatgtcggcagaagactgtaaacctgctgaaaagcgggtcccatggcagcaagcgcgcgatccacacgcagttgatttatggcatccagtctctgtttcagagtctcaatatagaggtacaagacgtatcgcctgatgttgctacccgtcatggtgcaggtcaatacttcaccgtcgccattcgggataaaccgtatgtcaaaaataaccgttaccctttctcgcctgcatatttttatctaataccgacgaaaaaatggtctaaaacgtgatcaatttaacaccttgctcattgaccgtaaagaaagatgcgctacatacaagtgtagcaccgttcgctgcgtgtaaattcttaaatacgggctggcggtttctcgtcattattcactgtcattgacgacactgcgccttatcctctcactcacggtgaccggaaaactaacatactctctataaggatgttaggatggtcaatgattgataatgacggtaacaagcatgttagacaatgttttaagaattgccacacgccaaagtccccttgcgctttggcaggcacattatgtcaaagacgcattgatggcaacccatccgggactgacggtagaactggtgccgatggtcacacgcggcgacgtgattctcgatactcccctggcgaaagtgggcggtaagggactgtttgttaaagagcttgaaatcgcgctgctggaaaaacgcgctgatatcgccgtgcactctatgaaagacgttccggtggccttcccggacggtctcggtctggtgaccatttgcgagcgcgaagatccgcgcgacgcgtttgtctcgaataaatatcacagtctggacgatctgcccgcgggtagtatcgtcgggacgtccagtttgcgtcgtcagtgtcaactggcggaacgccgtccggatctcattatccgttcgttgcgcggcaacgtcggcacacgtctcggcaagctggataacggcgactatgacgccattatcctggccgtggccggtctgaaacgcttaggtctggagtcgcgcattcgcacagccttgccgcctgacgtttcgcttcctgccgtaggccagggcgctgtcgggattgagtgtcgtcttgacgacgcgcgaacacaggcgctgctcgcaccgttgaatcactcgcaaaccgcgctgcgcgtaacggcggaacgtgctatgaacacccgcctggaaggcggttgtcaggtgccgattggcagctatgcagaaatcatcaacggtgaaatttggctacgcgcgctggttggcgcgccggacggttcggtgatggtgcgcggcgaacgtcgtggttctcccgagcaggcggagcaaatgggcatctcgcttgcagaggaactgctggaaaacggcgcgcgcgcgattctgacggaagtttataacggcgagacgcccgcatgagtattctgatcacccgcccctctcccgcaggggaagcgttagtgagccgtctgcgcgcactggggcaggtggcctggagttttccactgattgaatttgtcgccggtcgggagctacccaccctggccgaccgcctggcaacgctgacggaaaacgatctggtttttgccctttcacagcactccgtcgcctttgctcacgcccagctccagcgggatggacgaaactggcctgcgtcgccgcgctatttctcgattggccgcactacggcgctcgcccttcataccgttagcgggttcgatattcgttatccattggatcgggaaatcagcgaagccttgctacaattacctgaattacaaaatattgcgggcaaacgcgcgctgattttgcgtggcaatggcggccgcgaactgctgggcgaaaccctgacagttcgcggagccgaagtcagtttttgtgaatgttatcaacgatgtgcgaaacattacgatggcgcggaagaagcgatgcgctggcatactcgcggcgtaacaacgcttgttgttaccagcggcgagatgttgcaacgactctggtcgctgactccccagtggtatcgtgagcactggttactacgctgtcggctattggtcgtcagtgagcgtctggcgcacctcgcccgggaactgggctggcaagatattaaggtcgctgataacgccgacaacgatgcgctgttgcgcgcattacaataactctcataatgggatgccataatgacggaacaagaaaaatcctccgccgtggttgatgagaccagggagaccgtggaaaccacgccacagccagttaataccgagaaaaaaagtaagaacggcgccgcgctggtattaagcgcggtggcgatcgcgattgccctggcggcaggtattgggctttatggctggggaaaacagcaggcaaccgcgcaaacggaaaccagcgatgcgctggcgacgcaactgaccgccttgcaaaaggcgcaggagagccaaaaagcggagctggaagggattatcaaaaaacaagcggcgcagttagatgacgcgaatcgccaacaggcggcgctggcgaaacagcttgatgaagtacaacaaaaagtcgccaccatttccggcagcgatgctaaaacctggctgctggcacaggctgatttcctggtgaaactcgccggacgcaagctgtggagtgatcaggacgtcactaccgccgctgcgctgctcaaaagcgctgacgccagtctggcggatatgaatgaccccagcctgattaccgcacgacgcgcgattactgacgatatagccagcctgtcatccgttgcgcagatcgactacgacggcattattctcaagctcaatcagctctctaaccaaattgataacctgcgtctggcggataacgataccgatggttcgccgatggattctgacagcagcgagctgtccagctcgctaagcgaatggcgcgttaacctgcaaaaaagctggcagaactttatggacagctttattaccattcgccgccgcgatgataccgccgtaccgctgttggcgcccaaccaggacgtctatttacgcgaaaatattcgctcccgcctgttagtcgccgcgcaggccgtgccacgccatcaggaagaaacataccgtcaggcgctggataacgtttcgacctgggttcgcgcttattacgatactgacgacgccgcgacaaaagccttcctggaggaggtcgataaattaagccagcaaaatatcacgatggatctgccggaaactctgggaagccaggcgattcttgaaaaactgatgcaaacccgcgtgcgtaatctgctggcgcaaccgacagtctctacggcagcgcctgccacgcagacagacgctccggcagccgcgccgcaaggagaataatgatgctaaaagtattattgctctttgtgttgttgctcgcgggtatcgtggtcggcccgatgatagccggtcaccagggctatgtgttaatccagaccgataactacaacattgaaaccagcgtcaccggcctggcgatcattctcatcgtcgctatggtggtgctattcgccattgagtggttactacgccgtctgtttcgtaccggcgcgcacacccgcggttggtttgccagccgtaaacgccgtcgcgcccgcaagcagaccgaacaggcgctgctgaagctggcggagggcgactatcagcaggttgaaaagctgatgtcaaaaaatgccgaccatgctgaacaaccggtggtaaattatttgctggcggcagaagcggcgcagcagcgcggcgatgaagcacgcgctaatcagcaccttgaacgtgcggcagagctggcggggaacgacaccatcccggtcgagatcacgcgtgtgcgcttacagctggcgcgcaatgaaaatcacgcagcgcgtcacggcgtggacaaactgctggaggtcacgccgcgtcacccggaagttctgcgtctggcggagcaggcctatattcgcaccagcgcatggagttctttactggatatcatcccatccatggcgaaagcgcacgtcggcgatgaagcgcatcgcgccatgctcgaacaacaggcgtggataggactcatggatcaggcgcgtgccgagcagggcagcgaaggattacgcacctggtggaaaaaccaaagccgtaaaacccgccatcaggtggcgctgcaggtcgcgatggccgagcatctaatcgagtgtgacgatcatgatatggcgcagcagattatcatcgacggtctgaaacgccagtatgacgatcggctggtgctgcccattcctcgcctcagaaccaataatccggaacaactggagaaagtgctgcgccagcaaatcaagacggtaggcgatcgcccgctgttatggagcacgctcggccagtcgctaatgaaacacggtgaatggcaggaggcgaccctggctttccgcgccgcgctgaaacaacgcccggacgcgtatgattatgcctggcttgccgatgcgcttgatcgactgcatcaaccggaagaggccgccgccatgcggcgcgacggcttgatgctgacattacagaacaatcccccgcagtaattccctcttgcccggtggcgcttcgcttaccgggcttaccgcctacacaaaatcattcgggatgcataaaaaaacgcctgcccggttaaggggcaggcgtcaaaacaggtctgtatgacaacataaaggggtgcttcactcaacgttgtgtccagggtgtttgatgaggcgtaagcgacatctgtcagtggacgataagcaccgtaaacggctctgcatcattcctgagtttatgaggccagaaggcgaacataagagatggaatgagcatctacccgtacattattgcacataacgtgccatctttgcaccgctaaaaaacaggcgcaggcattaaaaaaacgtagagaattcacgcgattgttatccccccgccgctggcgaggttttagcgtgtcgcccggcggagacagaacaggatgctttttataaagtgattataaatcaatagattattcgtcaccgaatagcgacaaatgaagtctgggatatcgccaataaaccataatggcaacacgtgcgggataaggggttgaaaatgaacagaaaacaaaaaaccccgccgaagcggggctcaaaattggtcggcgagagaggattcgaacctccgacccactggtcccaaaccagttgcgctaccaagctgcgctactcgccgatatactgcttttttgaatttttagttcaattcattgagtcgtggtgcgaggggggggacttgaacccccacgtccgtaaggacactaacacctgaagctagcgcgtctaccaattccgccaccttcgcgtttcacaactctatattaatggggtggctaatgggattcgaacccacgacaactggaatcacaatccagggctctaccaactgagctatagccaccactgaaactttttacgcggtattaaaccaccgcagctcaagcacctaaataaatggtacgcccgacaggattcgaacctgagacctctgcctccggagggcagcgctctatccagctgagctacgggcgcttagcgccgttgcgggggtggataatacggacttcacaccccgctgtccagtgcctttttaaataaaatgcgcgtttggttatgctttgcgcattttggcgcttattcccccaccttgtgggcggttccgtgacgattcaggccgaaaactttgtagaccagcgtgacggccagcaggaagatgacgccgacaaacagcgacatgcgcgtatcttcattaaagtacatgccgattaaaacgcaaaccagaaacgccatcgtcaaatagttcgcccacggaaacataatggaacgaaaaggatgatccgcaatcgcttctttatgcgcccgacgaaagcgcagttggctaatcagaatgacaaaccacggcaccatccccggcagtacgctggcgctataaacgtaaacaaagacgcgctgcggattggggataatgtagttcaggcaagaacctaccagcaaaatcaaaatagagagcgccacgcccgcgaccggcacgccgtggcgagagaccttcgcaactgccgccggcagttgacggtttttcgccagcgcgtaaagcatacgcccacagctatacattccgctgttacagccggagagcgccgccgtcagcacgacaaagttgataatgcctgccgcggcggtgatgccgattttcgcgaaggtgagcacaaaggggctgccgttgctgccaatctcattccacgggaaaatggtgacgatcacgaaaatcgcgccaacataaaaaatcaggatacgccacagcactttacccaccgcgctacgcaacgtcacctgcggattcttcgcttcaccggcggtaataccgatcaactcaaccccttgataagaggccaccacgatacataatgcggtcagaaagcctttccagccgccggcaaaaaagccgccatgctcggtcagattaccaaagccaatcgcctggccgccgttaccaaagccgaagaaaatcacccccaggccgatgatgatcatcacaataatcgtggtgactttgatcatcgcaaaccagaactcgatttcaccatacaggcgcaccgcagccagattcgccaacgcgaccagtccgacggcaatcagcgccggtatccactgcgccatctccggaaaccagaactggacgtagaccccaatggcggtaatttccgagatcccgaccgccatccacataaaccagtatgaccaggcggtaagatagccaaaaaaaggactcatataccggtgggcgtacacggcaaaggagccggtaacaggttccagaaagagcatctcccccatcgaacgcatgatgaaaaagacgaacaatccggcgatgatatacgccagcagcactgacgggcccgcccatttcagcgtactggcggcgcccataaagagtccgacgccgatggtgcccccgagggcaatcaattcaatatgacgagcttccagcccacgctgtagctccggttttttctctgccataaatcctcatgtcgtgtttgcaacggttccggtagtaccggttattgttatgggtacatcgattgttgcgaatattttcttaaatttggacaaatggcaaatgaagcattaaaaaaatgcgcttattgtgtaagaaagcatcgattatgttgtaaatgagcagagccataagcacagtccgctgctcaagtcatcagaagggagaatcagagatcgccagtatagtgccagcgaagatagcgcagcagacgcatctggcgggtaatacgcttcggttgcgaaagcagacgatacaaccactccagccccaggttctgccatatttttggggcgcgtttgacgtgaccggtaaacacatcataggtaccgcccacccccatatatagcgcatggggatgcacttcccgacaatcgcgcatgagtaattcctgttttggcgatcccatcgcgacggtgacaattttcgcgccgctggcatggatacgcgcaaatagcgcctgacgctgctccggcgtaaagtaaccgtcctggctacccacaatattgacgttccactgcgtccgcagttttgcttccgtctgcgccagcacctcaggcttgccgccgacaaaaaataccggcgtgccttctttccccgcgcgcgccattaacgcttcccaaaggtcggcgccagccacgcgagaaacctgcgcctgcggaaattttttacgtattgaacgcaccacgctgatgccatcggcatatttaaattccgccgctgctatcaacgcgcggacttccggattatcttccgccgtcagcagcttttcggcgttgatcgccaccaacgtgccttgcttcagttgaccatcggcaaacagataattcagcgcatgtgacatgtcgcgccagccaatcagaggtaatccacgcagcgagtaaaggggcgcagcggcattattggtcatagttttccatccatctgtgcctgagggagcgaagttgtacgtttatgaatcagtccggcgctatcaaataaccagaacagaagtttagcgaccagcaggctggcgccaaaaaccaccaggaagaaaaccacgcgcgaaacaaacgaatccagcccttctcgcgccagcacaatcatattaaagatggcgccaaagcagaaactgtgcagaatcgccgccttatagcgattgggttcccggttacccagttcatacagccagtcgaaccatttgataatcagcccgacgacgatcgcgccgagcggaataaacagtgccccgcccatgaccaccagcgatccgataagcgttggcgatatcgccaagccagaatggttgttcaggacttcccaggtgaagtaattcgcagaattcagcacgatactgggtcgtcccggccataaccaggtaggaataaagacgtagaaatcacgcacgataggggccagcccctgaaaatcgatattgtggtaattttgcaacagcagcgccagattctcccacggcgaaaaggtatcgcgcgtcagataaagaaacgtatagaacgcctcatcgccgctcacatttaatccgtagcgtttgagcgccagccagaacataccgacaatccccagcacgcccgccgctgccagcatccacaggctgatccagccccgaataatgccgataaacaggaagatagcaaacgcaataatgatgttggcgcgcgtgccgccgacaatcatgtaggtcaacagaccaaacgcgacggtgctcaccagaaagaacagccacgctttgctgtcctggcgcaggaaatagaccaccagcatcgccggaatgaagaaatagaagaaccgttttaacgccacgccggaaacttcgctggaaaagatctggctgtaggagtgtagtcggaacagcaaaaagccgttatgcataaagaaaatcgccacgctcaccagcgcgatgcccatcaggatcacccaggtaaggtgggtttccacccggttcatggtaaatagcggcttgcgtggtacatccacaacgcgtttgcgtaaacgcgttttataggtcacgtaatacacgccgtagaaacaggcggcggataatagagcctgcaataagatttccggcggcgcgacgccaacgtcgaaacgaaataccagcacgctggttagcggaaaaccaaaaaagaaggtcaacaaaaaaagcaacgaaaagaaaacgttgaagttaaaacgcacgcggcggaattcaaaccaagtcagcgtggcgataaacagcgtagagagcagccagaccaccagcagcccgctgaattgcattaaactcattcggcttctcctgcggcgattctcaacgcattatgccacggttgcaggtagttggggctaaagaaggtgatgccgcttttatctaccgatgcgagctgacgctgcgcctcgcgcacgacctgctcattaagatcgtccgtggtaaacaggacgggcagatgctgttccgccatatcctgccagaaaggattgtcgcgattcaacacgcacgggatatcggcctgaattagcagacacaacgtcccgatcccctgttggcgggcaaaaataaaataaccgaggtcgcactggcgcaacagcgcaagataggcatcaaattccattttttcgctaagaatttgtagattttcggcgctaaatagcgccagaccggcctgacgaacctcatcaatataggcctggttattggctggatagcccatcggcaccaccacgtttaccgtgtcgccaaactgctgatacaccgcccgtaacgccgcaatatgttggttactgcgatcgccggagttccctaccaaaatggtcaatttccccgcacgttggcgctcttttgccatagcattcagagaaggatccatgcgcgtcgggaaatagagcaactcgccgcgtacgcccgggtgctggcgcgcaaaatagctgagatcgccgcgcgtcgcgaatacgccccctactcgcccctgcgcgatacgacgaagcgggtagaaaaggcggaatttcagcccgttggacacttcgtagagatccgcgccccagatatgccagtaaaactgggctggcttaataccgccgcttaacagcgccagccacagactgatgttgaactgcccgtgaaagaagaatctctgtcgacgatttgctttcgctttggcgataaccgcctgcgccagcgctttcttactgccataaaaacgaagcgagagtgccggacagctttccgtgaagccgttatcttcaccggcaaccataaattcgcgcgcgtgctcgcctgtggcggccagcgtatcattgaaaaaccgcagcacggtgtggttatggtgagggatatccgatcccaagacgtgaatcagtacagtcatgctcgcctacgccagagtaaaaatacgccgcaacaaagtgaaaaatagacaatataggtggccatataagcctgtgccgcacccagcgcgccgtgagcgggaatcagccagtgagcgaacgccgttaacagaatgaactggctaatttcggccagaatgtaaaatcgcaacgacgctttggcaatcaccagataaccgaaaacataggcgccgactttcagcacgtcgcccactaactgccaagcgaacagatcgcgcatcgcggtgaatttggcggaaaaaagcagccagatagcaaaatcgcgcaatagccagacggtaaaactcgccgccgcaaccgccggtaaaacaaatttcagcgcttttaccacttcacgcgtaatgtcctgtttttccgtcaggcgtgagagcgtaggtaacaggtaaacgctgaaggaggcggtgataaattgtagataggcatcagaaatactgctcacgccctgccagatcccgacatcgctccagctatagtgcgcggccagttggtttcgtatcatcacataggcgaccggcatcgtaacagaggtaatcagcgtcatcagggtaaatttactgagttgccctgccagaccgttgtcccaggagggcttgagatagcgtagcgggacggtgccgcgcttaatcagtattataccggctggcactaccaccagcgccggcaccagcgccaggccaagcagagcgccttcatagccgccgacacggtagcagagataccaggcggcgacgcccaaaaagctgccgacaattaacgataaggcattacccgacgcgtcacgaaagcccttcattagcgccagcagcaggttcgcccaggcgatccccatttgtaccagcgcaaccagacgcaccagcccttgatagttcgtatgaccgaacagtccctggctaatcggcgccgccgccagcaggaagaccagcgccagcagcgtagagaaccccaataccatcgcggaggaggttcccaccacggtacgtaactgcgccgggtcatcatgatgttgtgcgacgagtttggtaacgccgttaaatatcccggcgccagccaatacgcccagcacggtaatcatctggcggaagttacccgcttgtccgacgcccgacggaccgaaagagacggccagtagtttcaccaccagcagtccggcgccaatttttaccagcgtactgaccgccgtccacagggaggctttagcaagcgacatatcaggagaaataatttagcaaggtagtaatcaccgttcgttgatcgacgggcgcaaggttataaaacagcggcagacgcaacaaacgttcgctctcttttgtggtgtagacatcgtccccgataaactcgccgaatttatcgcccgccgggcaatcatgtagcggaatgtaatggaataccgccatgatttccgcctctttcaggaaattaatcagcgcgctgcgatcggcgatatcccgcagtttgatgtaaaacatgtgggcattatgcccgcagttttccggaatagaaggcagctcaatacgcccggcgcgcgccagcggcgttaacgcatcgtagtaagtctgccacagcgacagacgctgttgattgatacgatcggcggcctccagttgcgcccacaggtaggcagcctgcagatcggacatcaagtaactggagccgatatcccgccaggtgtatttgtccacctgaccacggaagaactggctacggttggtgcctttttcgcggatgatctccgcgcgttcaatcagcgtacgatcgttgatcagcgtcgcgccgccttcgccgccagcggtgtaatttttggtttcatggaagctaaaacagccgatgtgaccgatcgtccctaacgcgcgccctttgtacgtggacattacgccctgggcggcgtcctcgacaacgaacagattatacttatccgccagcgccatgatgacgtccatttcacaagcgacgccagcgtagtgtaccggcacgatagcgcgggttttatcagtaatcgccgcctcaatcagcgtttcgtcaatattcatcgtatccggacgaatatcgacaaacacaattttcgcgccgcgcaggacaaaagcgttagcagtggagacaaacgtaaagctcggcatgatcacttcatcgccgggctgaatatccaacaacagggccgccatctccaaagacgcggtacaggaaggcgtcagcaacaccttcgcgctgccgaaatgttgctccagccactgctggcaacgacgcgtaaagccgccgtcgccgcacagtttgccgctgctcattgcagactgcatgtattcgagttcggttcccaccaccggcggcgcattaaaaggaatcatgttgtcacctgtataaccagtacgcagtgctttcgatgttggcaccgctttgtatgtaacgtttaagcgcggcggtgttgcccaactgggtcgccacccgcaatgttgctttgccgcgactctgcgcccaacagatcgccgcctgcataagttccgctcccgcgccgcgtccggccaacaggccaatgcgcacgtcggtatcattcaattcccgcagcgagacgtaaccacggatagcgcctgtctccgtgcgaagcaccaggcattggtgatcaaacgtgccgcgtaccgcattctcaatccactgggcgtaaaaacgggcgctggcgtcgggcgcataccacggcgcgcgaaaacgactctgcgtaaacgcctctccggccaactgacgcaaagcaggaatgtccgtaagatgtgcaatttccgcgccatgctggtcgcgatgcccttttaccggcaacgcaaaatccacctcgccttcaaccaaagagaatcccagcgattgcaacgccgacagccaggcgatgttttcagccggcacttttgcctgcacgcgttgccatgcctgcagcgcttctggcgttaattcgggcgctgaggcatcgatacgcacaatgccgctattcacgccaaagaacgtattttcccagtgtaacggttcaatactggcgcggacgggcacggagcaactccagtaaatattggccatagccggttttttcaagctgactggcggcgcgtttcaaaccatcatcatccagccagccgttgcgccaggcaatctcctccagacaggcaattttgaagccctggcgcttttccaccgtctgcacaaaagtgctcgcctcaatcagactgtcgtgggtgcccgtatccaaccaggcgaagccgcggcccagcagttcaacggtcagcttaccttcctccagatacatctggttgatagaagtgatctccagctcgccacgcccggacggtttcacgcgcttcgcatactcgacgaccttgctgtcatagaaatagaggccggtgaccgcccagttagatttaggctgtttcggcttttcttccagcgagagcgcgcgaaaatcatcgtcaaactccacgacgccaaagcgttccgggtccatgacctgatagccaaatactgtggcgccttcggtacgcgccgcgacctgacggagtttggggctaaagccctgaccaaaaaagatattgtcgcccaatactaggcatgagggttcaccgttgaggaacgtttcgccaatgataaaggcctgcgccagcccgtccggactgggctgctcggcataatgtaaatcgataccgaatgctgcgccgtcgcccaacaaacgctgaaagtcgcgtttatcctccggcgtggtgatgatcaagatctcacgaatgcccgccagcattagcaccgataacggatagtaaatcatcggtttatcgtagacgggcagaagctgctttgatacgccgcgcgtaatgggatgcaaccgggtaccggaacctcccgccagaatgatgcctttcattcgtttctcctccaggagtaagagcctgccgtttagcgtttcagacctaagcgttcgccctgataactgccatcctgcacgggtttccaccaggcctcattggcgagataccactgaacggtttttcgcatcccgctttcgaaggtttcctgcggcgtccagcccagctcgcgggcgattttcgacgcgtcgatggcataacgtaagtcatggccgggtcgatcgtcgacgaaggtaatcagatcgtgataattcgccacaccctgcggtttttgcggggccagttcctccaacagagcgcagatcgtcctgaccatatccagatttttacgttcgttatgaccgccgatattatacgtttcgcccaccgcaccgttcgtcaccacgtgatacaacgcacgggcatgatcctccacatacagccagtcgcgaatttgctgaccgttgccatagaccggcaatggtttacccgccagcgcgttcagaatcatcagcgggatcagtttttccgggaaatggtagggcccgtagttattagagcagttggtgacaagcgtaggcagaccgtaggtacgtaaccaggcgcgtatcagatggtcgctgctggctttggaggcggaataagggctgcttggcgcatatggcgtggtttcggtgaagaaatcgtctgcagtatgcagatcgccatacacttcatcggtggagatatggtggaagcggaacgccgctttagcgtccgcgtcaagcgcggaccagtaagcgcgagcggcttccagcaaggtgtaagtaccaacgatattcgtttcaataaacgccgccgggccgtcgatggaacggtctacatggctttccgccgccaggtgcatcacgctatcgggctgatactgctggaaaacttgctccagtgatgcccgatcgcagatatccaccttctcaaaggcgaaacggtcgctttgcgccaccgacgccagagacatcaggttgcccgcataggtgagtttatccaccaccaccaccgcgtctgccgtttcatggatgatatgccgcaccaccgcagatccgataaagcctgcgccgccggtcaccagaatgcgtttcatcagcgccagacccctttggtatcaaccacataacgttgatgaaccgcatcgccgggaatcgctttaaattcgtcgtgatcgaccagcatcaccagcacatcggcggcggccagcgccgcgtccagtttcgccagcgtgcaaagtccgtccaattttttcggcaactgacggatattcggttcgacgaccagggtttcgccgctgtgccagcgggcgatactttgcgcgatccccatcgccgggctttcgcgcagatcgtcgatattcggcttaaaggccagcccaaaacaggcgattttcacttcgctggcgcgtttatcggtggctgccaggcaatctgcgaccgcggcttttacctgatcgaccacccagtgcggtttgccgtcattcacttcacgcgcggtgcgaatcagtctcgcctgctgcggattttgcgccacaataaaccacggatcgaccgcaatgcagtgcccgccaacgcctgggcccggctgcaaaatattgacgcgcggatggcggttcgccaggcggatcaattcccagacgttaatcccctgttcggcgcaaatcagcgacaattcattcgcaaaggcgatattcacatcacggaagctattttccgtcagcttgcacatctctgcggtgcgcgagttggtgacaacgcattcgccctcaaggaaaattttgtacagcgcgctggcgcgagccgaacatactggcgtcataccgccaatcacgcggtcatttttaatgagttccaccatcacctgacccggcagcacacgctccggacaataggcgatattcacgtcggcctgctcgcccgcctgctggggaaaggtcagatccgggcgcatcccggccagccagccagccatttgctccgttgcgccgaccggcgatgttgattccagaatcaccagtgcccctttttttaataccggcgcaatggatttcgccgcggcttccacataggccatgtcagggtcgtgatcgcctttgaatggcgtcggcacggcaatcaggtacgcatcggcctcgacaggtgtcgtcgtcgcacgcagaaagccgccttccaccgccatcttcaccacattgcccaacgccggctccacgatgtgaatttcaccgcgatttatggtgtctacagcatgttggttgatatccacgccgataacctgcttctggcgggaagcaaaagcggccgcagtcggtaatccgatataccccagcccaataacagaaatggtcgtaaaactcataacgatacccgataactttttaacgcctgtaaaatgcgcgcgcatgattgcccgtcaccataaggattatgggcgcggctcatggtttgatattcattttcgtcgtgcagcagacgcataacttccgccacaatgcgccgggagtccgtgccgatcagtcttaccgtaccagcggtaatggcttccggacgctctgtggtttcacgcatgaccaataccggcttacctaatgacggcgcttcttcctgaataccgccggaatcggtcagaatgagccaggcgtgattcatcagccagacaaaaggtaagtagtcctgcggctcaatcagtaccacgttttcaacatggccgaggatacggttgacaggttcgctgacgttgggattgagatgcaccggatagacaatttgcacattctggttcgcggcggcaatttccgccagcgcctggcagatatgctcaaagccctgaccaaagctttcacgccgatgaccggtcaccaaaatcatcttcttattcgcgttgaggaaaggatactgctcggccagttcagcctgtaatgtatcgctcgtcagaacgcgatcgcgtacccagatcagcgcgtcaataacggtattgccagtgacaaaaatgcgctcatccggaatgttctcccgcaacagattctgccgcgagttttccgtcggcgcaaagtggtacatcgccagatgtccggtcagcgtgcggtttgcctcttccggccagggggaatagagatcgccggttcgcaacccggcttctacgtgccctaccggaattcgttgatagaaagccgccaggctggtagcaatcgtagtggtggtatctccatgaaccagcaccacatcaggtttaaaatctgccaggatcggctttaatctctccagaattcggcaggtaatttccgtcaacccctgtcccggctgcataatgttgagatcgtaatcaggcacaatagaaaaaagagttaatacctgatcaagcatctcccgatgctgcgcagtaacgcatactttggcctcgaaatgaggatctttttccagcgcatggaccagaggcgccatcttaatggcctccggtcgtgtaccaaatacagtcagtactttcacatcgattctcttcgaatagacagtaggggcccagccccctactgcagaggtgttgctaaatcgtgcggcgacgggttaaggcaacgcccgcaccgattagcgccccaacgataccccacataatcatcaggaaggctcggcgtgggctatcacgttttaccggttcttccggcgtacgcaaataacgataggtctgaaaacgagggtccagggtcggccccacattaagcgtattcaacattgcccgattttgaaagtagtccaaatcgaacgcagggccaaccgcttgcagattttcaagacgcgcctgcaacatagggcgaccgagtaaaaaaagctctgagtccggtaattcatccgccgggacatctgtcgcgctacgagaaatattatgttgttccgcaattttgagcgcctgctcaatactgtttacacgacgcgaatagatcgctttcgcaacctcttcctgccgtttgacctgggctttcatctgcacggtacgcgcagcccaggcaccttttaattcatcattcagatggctcgccgcccgctggctggcgaatgcgacatactgacgcagcagattattggcatccggcgcagtttcagcaatcagcctcacgttgtcgttgatggcgcgtgtaaaatcgccgggcgtaaactgtatgttattgatcagttcatcaagcatcaccgcatcagctttgctattcccgaccattcgctgcttgtaatagtccgtctgtaaccagaaatcgcgacgcgtatcccaggaggcaagttgcatgatgaactctttatacgcttcatccatcaccgagggcttatcagaagaagcaggatcggtcttaatatccaggttgcgcagaaactgctgctgggagtaataaccgcccaacatatttacggttgggcgatcggtgatcgccgtcgcactccactcctgacgagcaaaaaaggtataggctaacgcgataagggcaaatagcaggccaatgccgataatccagaatttgccagcccataaagtacgaaacaacccgcgaatatccagttcattttcagcgctcaccgcgcgtgcccccggtaatggttgtgtcatcgtatcctcatttacttggttaagtttggccggttcttacgttgcctgcgcaggcgacgcttcacacgcttaataaatctcgccaccttccaggcccgcttaatgcagtagccatagaggaagaatgctagcaaaaagagcaccaacataacccattcaggaacaaaatgagagtattctgccgttacgcctactcccgtcagaatcgccgctgcgagcgtaataagaacaaatgcctggcgggaagtaaaccctgctcgcataaccaaatgatgaatatgttggcgatcaggggaaaaggggctcatccctttacgcagacggcgatacataatcgccaccatatccatcaatggaatagcgataatccatagcgcggtaaccgggctgatagagtgagttttcccctgcgtcgtttccagtaagagccagatgacggtaaagccaatcagtgtactaccggcatcacccataaagactttataacgccgccccaaaataccgagattaagcataatgtaaggcagaatcgcggcgatcatggcaaagcaccacattgccagactagtctgaccatcaaaccataaaatcagccccatcgccgcaaatgagacgctggataacccacccagcagtccgtcaataccgtccaccatattgaaagcgttgatcgccgcccatacggcaaacagagtaaggaaatagccaaaggggccaagcactaactcccaaggcccaaagatgtaaccaaggctacctaagtgaagttttgcgataaccatcattacaaccgcaataacagcctgaaccacagcacgaatttttacactgatatcaaaacggtcatccatcgcaccaacaaaaaccaatacaccagcgcaaataagatatagcgataagtgcggtatgtagtaatccgagaggccaaacataaagcagattcctgcaaacacagaaatcccgccgactaatgggataacgccctgatgtcgtttacgaaagtttggtttatccactaaaccaatttttatggctacttttcgcgcaagaaaaataaaaatggtcgtgaataaaaaaatactgattagctcagataaagcggtgagtaacttcacagtgtatgtgctctcagcatatatcatttccttaaagtataatgcgttacgccagctcctagaagagacctgttagaacattacactttttaccgcaaacaatgtgtattgtgcatggtgttactctgtagcgcatatcccgatgaccagtttatatgacatgacgccaggatgaatcgcaaaacaaaaacgccacgtaaaaacgtggcgttttcaggtaaagaccaggttatgagcgcttcatcatctcgaaaaagtcgtcattagttttggtcatcgccagtttgttaatgaggaattccatcgcgtcaatctcacccatcggatggatgattttacgcaggatccacattttctgcagctcttcctgagtggtgagcagctcttctttacgggtaccggaacggttgtagtcgatagccgggaagacacgtttttcagcgatcttacgcgagagatgcagctccatgttaccggtgcctttaaactcttcgtagataacttcgtccatcttggaaccggtatcgattagcgccgtcgcgatgatagtcaggctaccgccctcttccacgttacgcgccgcgccgaagaagcgcttcggacgatgcagggcgttagcatccacaccaccggtcagtactttaccggaagccggcaccacggtgttgtaggcacgcgccagacgggtgatggagtcgagcaggatgatgacgtctttcttgtgttcaaccagacgtttcgccttctcgataaccatttcggcaacctgaacgtggcgggatgccggttcgtcaaaggtagaggcaaccacttcgcctttcaccagacgctgcatctcggttacttcttccggacgttcgtcaatcagcagcaccatcagcacgcagtctgggtggttatacgcgatgctctgcgcgatgttctgcagcagcatggttttacccgccttcggcggcgcgacaatcagaccgcgctggccgcgaccgatcggcgaagccagatccagaacgcgcgccgttaagtcttcggtagaaccgttaccacgctccatacgcagacgagagtttgcgtgcagcggggttaagttctcaaagaggattttgttacgggcgttttccggtttgtcgtagttaacttcgttaactttcaacagcgcaaaatagcgttcaccttctttcggcgggcgaatcttaccagaaatggtatcaccagtgcggaggttgaaacggcggatttggctgggggaaacgtagatatcatcaggaccggcgaggtaggagctgtctgcagaacggaggaaaccaaatccatcctgcaatatctccagcacaccgtcgccaaagatatcttcgccactctttgcgtgctgcttcaggatggcaaaaataatgtcctgcttgcgcatacgggccaggttttccagccccatactttcgccgagagtgatcagctcagaaaccggcgtattctttaattcggtaagattcataatggtgtgagttcttaaacttggggtaaatctcgaacttaatgttgtgaatggtatggcagggtcatccatgcctgtttacggctatcaactcatgtctgttcgctgtctggtcacaggaaagtacgcagaactgaaacgacaagacggaatgagcgaagagccaggaatctttccacttctcgtgcgagaaaaaacgggaagtgacggataaaaccagattcaaacttaataaggtatgtttaattcgaagtcaatactaacttagcacgactcagaccgggcgtccagagatcctgacaatttaagaataacgtaaggacaacagacgccacgaaactgcctgataccttaatcattcgtcgaatgacagacgcctgaccatacagcgcctttgtcattcgacgtataaaaggtattacgccagattggcgtcgagaaactctttcaactgacctttagacaatgcgcctactttggttgccgccacttcgccgtttttaaacagcagcagagtcggaataccgcggatgccatatttaggcgcagtacctgggttctggtcaatgttcagtttggcaacggtcaatttgccctgatattcgtcagcgatttcatccagaatcggagcgatcattttacacggcccgcaccactctgcccagaaatcaacgaggatagccccgtccgctttgagtacatccgtgtcaaaactgtcgtcagtcaggtgaataattttatcgctcatatataactccacaggaataagcctggcgtgttggtgtagcattaaccaacgaggtgctgatgttaacttcgccaacaaaggttgactttatttcaccggatacgctttcgtaaagcaatagtaagctgatattctaccacactatgagcaaaacacatttaacagaacagaagttttccgacttcgccctgcacccacaggtggttgaagcccttgaaaaaaaagggttttataattgtacgcccattcaggcactggcccttccgctaacgctggcgggtcgtgacgttgcagggcaggcgcaaaccggtaccgggaaaacgatggcgtttctgacgtcaacgtttcattatttactttctcatcccgcgatcgacgatcgcaaggtgaaccagccgcgcgcgctgatcatggcgccgacgcgtgaattagccgtacaaattcacgcagacgcggagccgctggcgcaagcgacaggcttaaaattaggcctggcttacggcggcgatggttacgacaagcagcttaaagtgctggaaagcggcgttgatattcttattggtacgacgggccgattgatcgactacgccaaacaaaaccacattaacctcggcgccattcaggtcgtcgtactcgatgaagccgatcgcatgtacgatttgggctttattaaagatatccgctggctgttccgtcgtatgccgccggctgcgcagcgtctgaacatgttgttctccgccaccctgtcttatcgggttcgcgagctggcgtttgaacagatgaacaacgccgaatatgttgaagtggaaccggagcaaaagaccggccaccgcattaaagaagagcttttctacccctctaatgaagagaaaatgcgtttactgcaaacgctgatcgaagaagagtggccggatcgcgccattattttcgccaacaccaagcatcgttgcgaagatatctggggacatctggcggcagatggccatcgtgttggtctgctgaccggcgacgtcgcgcagaaaaagcgcctgcggattctggatgagttcacccgcggcgatctggatattcttgtggcgaccgatgtcgcggcgcgcgggttgcatatccccgccgtaacgcacgtctttaactacgatctgccagacgattgtgaagactatgttcaccgtatcggtcgtaccggtcgcgctggcgccagcggacattccatcagcctggcttgtgaagagtatgcgctgaatctgcccgctattgagagctatatcggccactcgattccggtcagcaaatacaatccggaagcgctcatgaacgatctgcccaagccgttgcgtctgacgcgttcgcgtcctggcaatggtccgcgccgcgctggcgctccgcgtaatcgtcgtcgttcaggttaagaaaagttatgccatacacaaaatcatttagcctgtatcaaggcggcaagaaaacaaatcccgatgagcttaggaagagtacgcagccaacacggatacaggttgaaggatgaagtgtatgaattccacctcgttgtatgccgccattgatctcggttccaatagttttcatatgctggtcgtgcgcgaggcggcgggaagcatccagacgctgacccgaataaaacgcaaggtgcgtctggccgcgggtctgaacaacgacaaccacctttcagccgaagcgatggaacgcggctggcaatgcctgcgtctgtttgctgaacgtttgcaggatatcccgcagccacaaatccgcgtggttgccaccgcaacattgcgtctcgccgtcaatgcaggtgaatttatcgcgaaagcgcagactatccttggttgtccggtgcaggttatcagcggcgaagaagaggcgcggctaatttatcagggggtcgctcataccaccggcggcgcagatcagcgactggtggtggatatcggcggcgccagcactgaactggttaccggcactggcgcgcaaaccacgtcgctgtttagcctgtcgatgggctgcgtaacgtggcttgaacgctattttagcgatcgtaatctggcgcaagaaaactttgatgatgcggagaaagccgcgcgcgatgtactgcgtccggtcgccgatgaactgcgttttcatggctggaaggtctgcgtgggtgcctccggcaccgtacaggcattgcaggaaatcatgatggcgcaggggatggacgagcgcattacgctcgccaaactgcagcagctaaaacaacgcgcgatacagtgcgggcgtctggaagagctggaaatcgaaggcctgacgctggagcgcgcgctggttttcccaagcgggctggctattctaatcgcgatatttaccgagctgaacatccagagcatgacgctggcaggcggcgcgttacgcgaagggctggtgtatgggatgttgcatctggcggtagatcaggatatccgcagccgcacgctgcgaaacattcagcgtcggtttatcgtcgataccgatcaggcaaatcgtgtggcgaagctggcagataacttcctcaaacaggtagaaaatgcctggcatattgaacctatcagtcgtgaactgttgcttagcgcttgccagttgcatgagatcggtctgagcgttgattttaaacaggcgccctatcatgccgcctatttagtacgccatttggatctgcctggctatacgcccgcgcagaaaaagttgctcgccaccctcttactgaatcagaccaatccggtcgatctctcttcgcttcatcagcaaaacgcggtaccgccccgtgttgcggaacagctatgccgtttgctgcgactggcgattctttttgccggtcgccgtcgtgacgatctggtaccagaaattacgctacaggcgctaaatgaaaatctgacgttaaccttgcctggcgactggctggcgcatcacccgctgggtaaagagttgattgatcaggaaagccagtggcaaagctatgtacactggccgctggacgttcgctaaccgtagtctgattgccggatgacgctgcgcttatccggcctacgatttcgctcgctttgccgccatcatggctttcagattagccaggtgactttgccctttttgcattcgctcctcagcgcttaccactttgcgctcctgctcccagattaaatcatcctgcggcagttctaacaggaagcgactgggttccgggcgcaccagtttcccatactgacggcgctctttacataatgtaaaggtgagctctttctgcgcacgagtgatcccgacataggccagccgacgctcttcctcaatattgtcttcgtcaatgctgctttgatgcggcaaaaatccttcttccattcccaccatatagacatacaggaattccagtcctttcgacgcatgaagcgtcatcaactgtacctgatccagctcttcttcgctctcgccgcgctccatcatatcgcgcagcgtaaagcgtgtaaccacctgggtgagcgtcatcggctcatcgagttcgttgccttccagcatctcagtcatccagctaaagagctggttaacgtttttcatacgcatttccgccgctttggggctcggcgaggtttcgtacaaccaggattcatagtcaataccgtggatgagatcgcgcacggcggcgacaggctcacgttcggccagacgctggatttcccccagccagtgggtaaaacgcgtcaatgaatcgtaaccacgtccggtcagcttctggctaagccccatatcaaagctggcggtaaacaggcttttattacgcgtcattgcccattcacccagcttttgcagagtggccggaccgatttcgcgttttggcgtattcacgatgcgcaggaaagcgctgtcatcatccgggttggtcaacacccgcagataggccagcaagtctttaatctccggacgggagaaaaatgaggtgccgccggaaattttgtacggaatgcggttctgcatgaggaatttttcaaatacccgcgactgatgattcccgcgatacagaatggcgtaatccttgtactgggtcttgttcacaaagtgatgggcaatcagttcgccggtaacgcgctcagcttcatgctcttcattgtttgcgcttaacactttgagttccgcgccgtaaccgagttcggaaaagaggcgcttttcaaagacgtgcggattgttggcgatgagaatatttgccgctttcaggatgcggcccgaagaacgatagttttgctccagcttaatcacctgcagcgccggaaaatcctggctcagtaacaccaggttttgcggacgcgccccgcgccaggagtagatagactgatcgtcatcgcctacgaccgtaaagcgcgcgcgttgcccaaccagcagcttaaccaactcatactggctggtgttagtatcctgatattcatccaccagcagataacgaattttattctgccagcgctcgcgcacctcgtcattgcgttgcagcagcagcgtcggcagcaaaatcaaatcatcaaaatcgagaacgttacatgccttcatatgggcgtcgtaaagcccgtagcagtgggcaaaaatacgatcgcgttcacctttcgcccccgccgctgcctgtgcaggcgttttgagatcgtttttccagttggagatcgtggagatcagctgttgcaacagaaccttgtcgtcttcgatcaggccttcggtcagctctttgagcaaggcgacctggtcggtatcgtcaaacaatgaaaagttcgatttcatccccagcgcagcgtactcgcgcttaataatatccagccctagcgtatgaaaggtggagatcatcaaaccgcgcgcttccttacggccgagcgtctgcccgacacgttctttcatctcacgcgctgccttgttggtaaacgtcaccgccgcaatatgccgggcctgatagccgcatccgcggatcaggtgggcgattttattggtaattacgcgagttttaccagaacccgctcctgccagcaccaggcagggtccggtgacgaattcgacagcgtgttgttggccaggatttaaacgcatgggaatagtgctcaatcttcgaacgggggagggattgtagcagaaagcgaggcccagagaagaccaggctgctttttcaggcagcctggaaaaggtcaatcagcaggctctggcggcaagcgacgtatagccattacgctgtgcgctcttgatccaactgtaagaacccattagcgcgatcaccgtcagcagaacatactcaagcgacatcgcataaacgccctgtactgcatagatcacgacgctaattacatcaataatcacccacagcagccagttttccacgtacttgcgggtcatcagcaccatcgccgcaatcgacaacaccagcatggtggaatcccagaacgggaacgcgtccggctggagttcaggcatcgccacctgcatacctaccgtttgcagcagagcgagcataacgcgggtcaacatagcgaagaccggatcgataaaccacgtcatcagcagaatgctaataatacatatgccccccaacctccatgtttgttgacaagaaagccagcgtactttcagagcggcttcccgggcgtcattctgccggctccatgcgtaccagccgtaaatattcgccgcaaagaaaaacacctgaagtagcaagctggcatacagttgaatctgaaaaaagatggcggcaaacagagtgacgttaatcaagccaaacaggtaattaatgattttttcccggctggcgcaccagatgcacaataagccaaagacggtaccgatagcctcaatccacgatagcgcatacccaccctcgccgagaggaatgttgaccattacattgttaatgctgaaaaagtccatcattgctctccttgcaaactatcgaaataaatggcctgaagcgccagagaaatctggcgctcttcaccttgctggcacaaggtttcctgctgaacataatggttaatgctgctctccagacagccactatgcgcgacgaccacgtttagcaacgacgcggtacgcagcccacgtaacgctcccaccaccatcagcgcggcggtttccatatccgcgccgagaactcccctggccgaccattcggcatccagttcagcttcgcgatcggtataaaaactgtcatggctgcgcaccagcccgcaaacggcagagatgttcatctgtttcgcctgctgtatcagcgtggcggtaagataagggtccgcacaggccggataactggcgggcgcataggttttgctggcgccgtcgtcagccaccgcgccgtgggcgatgatcacatcgcccaacgccagcgagtcctgcaacgcgccgcaactaccgatacggattagcgtgttgacgccaacctggcgtaactcctcaatggcgatagcggttgacggtccgccgattcccgtggagagcacgactatttcaaccccctggtaccagccgcgcgccgcgcgaaactcccggttttgcctcagaatctcagccttatcaagaaaacgggcgattctatccacccgcccgggatcgccgggcaaaagcgcatatttcgcgcgggtcatgcttgtgttaagccgaatatggggttgcatctccctctccttattgttctgagaggttcagatttccgcctcctgtttgagtttttcaggagccagtaaaatgatccgctcaccgtcggtatcgataatgttcagcgatttcagatcgtgcagtatccggttgatactgcgcgtcgtcgccgcaaattcctgaccaagattctgcttatcaagcaaaatagtggttgattcatattgttgataacgcagccataatgcctggcatacgcgctgatgcagcgagtacaaattgtcgctactggcctttttcgacaactggtaatactgttggctgaaaaaccgcagcattcgctggttaaagtggttatccagcgtcagccagcggcaaaaatgtgcttgcggcaggctaagtagctgtacattgccgacggctacgacagaacagatgtaatgccgcgactcaaatatctctagctcgcccagcatgtctcctttgccataacgcgcctgccggtaacggcgtccatcttcagcttcgtaaaaaacatccacttcgccggccacgatgagcgaaaattgctagcatgtttccccctggcggcagataagcgcgccgcgggaaatgtcgtcaaatcgccagcactgcatgatttccaacgggcagtatttgagtaattcatagagcactgggtcgcgtacgacctggcgtagccctaaaagccagtcgtctggaaattctgcgtttttcattatgttcatggtatctcgccccttgtcagaaaggacaggaccgtcgtcccgcccatccgaaatacgcccgctaaaaatgccgcttatctcccggttcattaaatcaggcgggacatctgtcctgtaatggcgaagagtatatgtctgacggcctaaggagtgataaagtgacggccaatctttgcgacgtgagaacacaataatggcaaaaatggcagcagcactgcatattcttgtaaaagaagagaaactggctttagatcttctggagcaaattaaaaacggcggcgattttgagaagctggcgaagaagcattctatctgcccatccggtaaaaaaggcggtcatttaggcgaatttcgtcagggccagatggttccggcattcgataaagtagtcttttcctgcccggtactggagccaaccggcccactgcatacccagttcggttaccacatcattaaggtattgtatcgtaaataaaaagccgggtggcggctacgccttacccgacctacatcgtctgcttgattttgtcggtcgggtaagcgctagcgccacccgacaaggtatatcaacccgctaccgcaatacgcttcatatccgtcatatagccgcgcagtttcttacctacctgctcaatcgcatgactacgaatcgcgtcgttcacgtcgcgaagctgtgcgttgtttaccgcgcctttcgggatagcactacccagatcgcccggttgcaattccgccataaacggtttcagtagcggtacgcaagcgtaagagaacaggtagttaccgtattctgcggtatcggagataaccacgttcatttcgtacaggcgcttacgggcgatggtgttggcaatcagcggcaactcgtgcagtgattcgtagtaagcggattcttcgatgatgccggaatcgaccatggtttcgaacgctagctcaacgcccgctttcaccatcgcgatcatcagaacgcctttatcgaagtactcctgctcgccgattttaccttcaaactgcggcgcggtttcgaacgcggttttaccggtctcttcacgccaggtcagcagtttcttatcgtcgttcgcccagtcagccatcatgccggaagagaattcgccggagatgatgtcatccatgtgtttctggaacagcggcgccataatctctttcagctgttcggacagcgcgtaagcacgcagtttcgccgggttagacagacggtccatcatcagggtgatgccgccctgcttcagcgcttcggtgatggtttcccagccgaactgaatcagtttttcggcgtatgccgggtcggtgccttctgccaccagcttgtcgaagcacagcagagaaccggcctgcagcataccgcacagaatggtctgctcgcccatcaggtcagatttcacttccgccacgaaagaagattccagtacgcccgcacggtgaccgccggtggccgcagcccaggctttagcaatcgccataccttcgcctttcggatcgttttccgggtgaacggcgatcagcgttggcacaccgaagccacgcttgtattcttcacgtacttcggtgcccggacacttcggtgccaccatcaccacggtgatgtctttacggatctgctcgcccacttcgacgatgttgaagccgtgggagtaacccagcgctgcgccgtctttcatcagcggctgtacagaacgtacaacgtcggagtgctgtttgtccggcgtaaggttaaccaccaggtcagcctgcgggatcagctcttcgtaggtgcctactttgaagccgttttcggtcgctttacgccaggaggcgcgcttctcagcaatagcttctttacgcagggcgtaggaaatatccagaccggagtcacgcatgttcaggccctggttcagaccctgagcgccacagccgacgatgaccacttttttaccctgcaggtagctcgcgccgtcggcgaattcgtcgcggcccataaagcgacatttacccagctgcgccagctgctggcgcagattcagtgtattaaagtagttagccatgatggtgtactccgtgatgttgtgttgtcgcgcttattgttcggtttacagattgctatctgtgcgaatgaacccacattacaacaggaaatttattgcggaaattgatatattcacaacgttatgttgcggtttatgcaacgtcaaaaaccggaggtctgtctgtggatttacgcgatctaaaaaccttcctgcatctggcggaaagccgccattttggccgcagcgcgcgggcgatgcatgtcagtccttccaccctttcccgacagattcagcggctggaagaagacctcggccagccgctgtttgtgcgcgataaccgtacggtcacgctgaccgaagcgggtgaagagctgcgagtgtttgcccaacagacgcttttgcaatatcagcagttgcgccataccctcgatcagcaggggccgtccctttccggcgaactccatatcttctgttcagtgactgcggcgtacagccacctgccgccgattctcgaccgttttcgcgccgaacacccttctgttgaaatcaaattgacgaccggagacgccgccgatgcgatggaaaaggtggtaacgggagaagcggacctggcaatcgccggcaaaccagaaacgctgcccggcgcggtggcgttttcgatgctggaaaatctggcggtggtgctgatcgccccggcgctgccctgcccggtgcgtaatcaggtgtcggttgataagcccgactggtcaacggtgccgtttatcatggccgatcagggaccggtacgccgccgcattgagctgtggtttcgccgccataaaatcagcaatccgcagatttacgccaccgtcggcggtcacgaagcgatggtctcaatggtggcgctgggctgcggcgtggcgctgctgccggaagtggtgctggaaaacagtccggagccggtgcgcaaccgggtgatgattttagaacgcagtgatgaaaaaacgccgtttgagcttggcgtctgcgcgcaaaaaaagcggctgcatgagccgctaattgatgcgttctggaagattttaccgaattagttttacggccctaccattacccgaacaggcttcccaatacggctaagcatattcaccagagcatcaatggtgaatttgctgcatttcttgttgacgacatccgaaacgcgcggtcgggatatatgcaaaactgtagcaacctcggcttgcttcatctggttttgcgtaatccagagggtaatttcttccattagctgttgtttaatggctaacgtgttttcgatttcattcagggaatcagcgtaaaacttttctgcgtcctgcttatgaaaccccaaatcagcaaaaacattaccgccagatggcgtcacatggcgaaaatcactatcagttttggcaatcacaagctgtttctccgttgttgcaccacccggttataacgcgttctggcgatgtttttatcatgctgactggtttgttgcgtctgtttttggaaactatgcaaaacgtagagtgcttctgcaaaattagcgacatacataacgcgatagataccattgttgttacgaatacgaatttcatttaccccagccccaatttctgaaaacggtttccagtcatcgggttcaattccatactgaattttgtgaagctgataaccgactgctttacgtaccgttatgggaaaagccaggagatcctccagagaagatcccacccatcgaatttctttttcattggagagagctcgggtgagtaacataacatctttgtgtataaaattttatacattgtttttagcaggtgcaagtgatggcggtgctaatgatatggagccgagtttcaccacaagcagattgggcgccttctggaaaacgtctcgcaaaatgaaatgagtggatgctccgggctggcaggaaagcccaataactgagggaagataatatctggatattaggcccactttactttgtgggcccgaaaaactaaacgctgaattaacccgccagaaagaaccggaacgccgggttattgctctcatcatggcattcatagcccagttcatgcagccgggtttcgaaatccggctcatgatcgcctaactcgaacgccgccagcacgcggccataatcggtaccgtggctgcggtaatggaatagcgaaatattccagtgcgtgccaagcgtatgaaggaatttgagcaacgcgccgggcgactccggaaattcgaaactatacaaacgctcctgtaatggcttggaggggcgcccgccgaccatatagcgcacatgcagcttcgccatttcatcgtcggagagatccactacgctataaccgccgtcgcacagttgggtgataatctcttttcgttcctccagcccctgactgacgcgtacgccgacaaaaatacaggcatgtttcgcgtcggcaaaacggtagttaaattcggtgaccatacgcccgccaagcaactggcagaatttgaggaagctccccttttcttccggaatggtcaccgccagtaacgcttcgcgctgttcccccagctcgcagcgttcagacacatagcgcaagccgtggaagttgacgttggcgccggaaaggacgtgcgccaggcgttcgccgcgaatattgtgctgggcgatatattttttcatccccgccagcgccagcgcgccggacggctccgccaccgcacgcacatcttcaaacaggtctttcatcgccgcgcagatcgcgtcgctatcgactgtaataatgtcgtcgagatattcctggcacaggcggaaggtttcgtcgccgatgcgttttaccgccacgccttcagcaaataacccaacgcgcgggagatccactggatgaccggcttccaacgccgctttcaggcaggcggaatcctccgcttcgacggcaatcactttgatttgcggcatcaattgtttgatcagtaccgctacgcccgccgccaggccgccgccgccaaccggcacaaagacacgatcgagatgcgaatcctgctgaagcagttccagcgccagcgtgccctgcccggcgatcaccattgggtgatcaaacggcggcacccaggtaaaaccctgctgctgcgccagctcaatagctttcgctttcgcttcatcaaaattagcgccgtgcaacagcacttcgccgccaaaaccgcgtaccgcatcgactttaatatccgccgttgcttttggcatgacgatcagagacttcacgccaagccgcgcggaggagaacgccacgccctgtgcatggttccccgccgacgcggtaatcacgccgtgggctttttgttcttcggtcaatccggccatcatcgcgtaagcgccgcgcagcttaaagctatgtaccggctgccggtcttcgcgtttgacgagaataacgttgtccagacgtgacgagagcttttccattttttgcagcggcgtcacctgcgccgcttcgtatactggcgcgcgtagcaccgcgcgcagatactccgccccttccggcgcgactgacagaggttgagattccgccatcatcaacctcccagtttcgatttatcgcgcaccgcgcctttatcggcgctggtcgccaggctggcgtaggcacgcagggcaaacgaaacctgacgctgacgatttttcggcgtccaggctttatcgccgcgagcttcctgcgcctcgcggcgtgcggcgatttcagcctcgctcaactgcaactgaatgctgcggttcgggatatcaatcgcaatggtgtcgccatcttcaatcagcgcaatagtgtcgccgctggccgcttccggcgagacgtggccgatggaaagacccgaagtaccgccggagaaacgcccatcggtgatgagcgtgcaggctttgcccagccccatcgacttcaggaaactggtcggatagagcatttcctgcattcccggcccgcctttcggcccttcgtagcggattacgaccacatcgccttccactactttgccgccgagaatcgcctctaccgcatcgtcctggctttcgtaaactttgacaggaccggtaaatttaaggatgctgtcatccacgcccgcggtttttacgatgcagccgttttcggcgaagttgccatacagcaccgccagaccgccgtctttgctataggcatattccagcgagcggatgcaacccgctgcgcggtcgtcatccagcgaatcccagcgacaatcctgagagaacgcctgggtagtacggataccggcagggccagcacggaacatttttttaaccgcttcgtcctgcgtaaccgtgatgtcgtactgttccagcgtttgcggcagcgtcaggcctaatacgtttttcacgttgcggttcagcagcccggcgcgatccagctcgcctaaaatacccagcacaccgccggcacggtgaacatcttccatatggtatttctgggtacttggcgccactttacacagctgcggcaccttgcgggacagcttgtcgatatcactcatggtgaagtcgatttccgcttcctgcgccgccgccagtagatgcagaacggtattggtcgaaccgcccatcgcaatatccagcgtcatcgcattctcaaacgccgccttgttggcgatgttacgcggcagtgcgctttcgtcatcctgctcgtaatagcgtttagtcagttcaacaatccgcttaccagcattgaggaacaactgcttccggtcagcatgggtcgccagcagcgagccgttgcccggctgcgacaggcccagcgcttcgatcaggcaattcatggagttagcggtaaacatgccggagcaggagccgcaggttggacaggcggagcgttcaacctggttactttgatcgtcagagactttcgggtccgctccctgaatcatggcatcaaccagatcgagcttgatgatctgatcggacagtttggttttcccggcttccatcgggccgccggagacaaagatcaccggaatattcaggcgcagcgaggccatgagcatccctggggtgattttgtcgcagttggagatacacaccatcgcgtcagcgcagtgagcgttcaccatgtactccacggagtcggcgatcagctcgcgcgacggcagtgaatagagcatacccccgtgccccatggcgatcccgtcatccacggcaatagtgttgaactctttcgccacaccgccggaagcttcaatctgttcggcgaccagcttaccgagatcgcgcagatgaacgtgacccggcacaaactgagtgaatgagttcaccacggtgataatcggtttgccaaaatcactgtcggtcattccggtggcgcgccacagcgcgcgggcacccgccatattacgaccatgagtggtggtggcggaacggtacttaggcatgctttatttactccccattttttcccttcatacttcacgccacaggtgcgttggctgcctcactccagtcacttactacagtaagctcctggggattcgctgcgttgccgccttcctgtgacgcaaattattttgggaaaatattaattttatttattatgaatttaccggatccaaccagccccatttatcctcggtttctccagtgaagagaccaaagaaggcttgttggatacgcttggtaacagggccgcaacggccttcgcctacctggataccatcaacgctgcgtaccggagtaatttctgccgcagttccggacataaacacttcgtcggccagatacagcgattcacgggacagcacctgctcacgcacttcaatacccagctctttcgccagtttgatgatcgcgtcgcgagtaatgcctggcagcgcggaagaggtaaacggcggagtaaacagcacgccatcttttacctcaaacaggttttcgcctgcgccttcggatatatagccgtttacatccagggcgatgccttcctgatagccgtggcggcgcgcttcgctacccaccagcagtgaggaaagatagttcccgcccgctttggcggcggtcggaatggtgttcggcgcagcgcggttccaggaagaaaccatcgcatcgatcccctgatccagcgcttcggcgcccaggtatgccccccacgggaacgcggcgatgatgacgtcagtggtgtatcccgggggcgggttaacgcccataccgacatcgcctacaaataccaacggacggatataggcgctggtcagattatttttacgaattacgtcgcggcaggcttccatcagctcatcaatgctctgggaaaccggaaaacgataaatttttgctgagtcgcgcaggcgctgcatatgttcacgatgacgaaacactaccgggcctttgtgagagtcgtagcaccgaatcccttcaaataccgacgtaccgtagtgcagcgcgtgagacattacgtgaaccttcgcgtcttcccagcgcaccatctcgccattgaaccaaatgtaatcagcttttttcgtcgtcatttttcttccttttgcgctcaggcgcggatttgttgtgatgtggcagcgctctggcagattgcgacatgcgcaacatctaccagtttacttaactgactaaacagtaagtcgaccgaccggggactggcaacggtcaattcaatatttatattctgcgcatcggtcgcggcttccatattcatggagcacacctgaaaaccacgatggcgcaccacgcgtaaaacacgttctaaggtttctggattaaagcgtgccgatacattgacctgatgttgcatcatgataatttctccagcatttcagagttactggcgccaggcggcaccaacggccagacattttcaagttcgtcgattgagacgtgaagcaggtacggcccttcgcttgccaacatcgtgtcgagtgccgcttcaacctggtctttacgagtaatgtgctggcctggaatgccgaaggcgctggccagcatgaggaaatcggggttatcggtcagggtggtttcgctatatcgctcctggaaaaacagttgctgccattgtcgaaccatccctaaccgctggttgtcgagtaagactatcttcaacggtaactgcttgcgttttacggtgcccaactcctgaacattcatcatgaaggagccgtcaccggagatacagataacggtatcattcggtcgcgctacctgcgcgccaacggccgccggtaagccgaatcccatcgtccccagaccgctggaagtgatgaagttctccgggcgggtgtaagtcatatgctgggctgaccacatctgatgctgccccacatccgtcgtcaccacactgtctgcgggtttgcgttccgacaattgcttcaacaacaacggcgcatagatagtctcgccaggatggtcatagcgccaggcgtgttctgcgcgcagctctgcacaagactgacgccatgcgtcgatcttcagcggttgctgtaatgccggcaacagcgaatttaaatcgccctgcaacgcgacgtgtgcctgacgcagtttgttcatttccgccgggtcgatatccatatggattacgctggcgttaggcgcaaacgtattcagcttaccggtcacccggtcatcaaaacgtgcacccactgcgatcagtaaatcacactcttgcaccgcgaaattagccgctttagtaccgtgcattcccagcatgcccagatagtacggataatcagcttcaacagcccccagacctttcagcgtgcaggtaactggcatttgcgttaccgcgataaatttacgcagcgccggaaccgccttcgccataccaacaccaccgccgacgtacagcatgggttttttcgcctgttccagcatctggcgcgcctgttccacatcagcctgcgggaaagtcgcttcgttatcgacggtagtaaaccagggttctagctcaccgctggccaactggatatctttcgggatatccaccagaactggtccgggacggccagcgttggcgacttcaaaagcctccgccatgatgcgcggcaactctgccagcgactgcaccaggaagctgtgtttggtacaggccagcgacagccctaacacatccacctcctggaacgcatcggtgccgatgaacggggcggaaacctgacccgtgatcgcgacaacggggaccgaatctaacaacgcatccgccaggccagtgatcaggttagtggcgccagggcccgaggtggcgatacaaacaccggttttgccggtagaacgggcataaccgattgccgtcattgcggcaccctgctcgtgtcggcacaacaaatgctccacaccaccgtcatacaacgcgtcgtaaaccggcataattgcgccgccaggataaccaaatacggttttcaccccctgcgctcgcaaagcatgtaccacccactgtgccccgttcatagttacatccccgtcgtaaatcttgagaaacagaattttatgctgttattcacgctctgctcctcgcttaagtttttcaggccaaaaaaaacccccggacctttcggtgcgggggtcttagttcgttaaggcttgatttctaagcctttcctcgtccaagtgcagccccgcacggtgggataataatcaccaccacgctaatcacgaccaggctaatcactcgtagaagggctgtcatttttgtctattcttgcatcttgttcgaaggaatacctaaagagttaccataggttttgccaatagcacaagatatttttttaaccacgtttcagataatgcaggtgaatgcctaaaagggctttgttttttataagaaaaattagcaactgaaaaattttcacgttttcctcccccttttggtgcgctttacaccctgttttccttcttttcgcttctgcgagcgttcttccagtttgatgtttcttacctgaaaatgacgccaaaattcaggaatcagccgctaaaaaacaaaaagtcagtaattcgattttctcttctattccgcataatccacgtaacaggagggattatgtcactggcgattgttcatactcgcgccgcacttggcgtcaatgcgccgcctatcactatagaggtgcatatcagtaatggattaccgggattaaccatggttggcctaccggaaaccacggtaaaagaggtgcgtgaccgggtacgtagtgcgattattaatagcggatatgaatttccggctaaaaaaataaccatttatgtaaacgggttaatgaaaacaacaagttagattaaaaacaataagttaggttggtggtcagtggtggttattacggggtaatgccaaccgctgccgccactttgtcgccacttggcagcgttgccagaggattgaaacggagcgccgtttccagatgatccggtgccagatgtgcgtaacgcatagtcatttttatatcgtggtgtccgagaattttttgtaaggccagaatgtttccacccgacatcatgaagtgcgccgcaaacgtatggcgcagaacgtgtgtgagttgaccgcgagggagcacgatagacgttttttccatcacggataaaaattgaaaatagcagtctgtgaagaaattgaacccatcaagcgccatgatctcttcgtaaagctctttactgatagggatgcttctgtttttcttccccttcgttcttacaaaggtaattcggtatttggtcacctgtgaacgagtaagatttacggcttctcgccagcgtgcgcctgtgcttaagcatatcttaactaccagtgctagaattgggtcctgacgtttgcaatcagccagtaattcaacaatctgctcatgggtaagccatgccatctctttttctgcgatggtgaattttcgcatgttctccagtgggttcggatacgaccattcgcccagacgggatagttcgctaaaaacactacttagatagctttgctccaggttaatggtgaccgggcttgctcctttcttccatttctcgctgaagtagatctcgcctgtcaggcgtttatctcgatagtgggcaaacattttagaggtgagatcggttgcaagaggattgcccagagcgtcaaccatcagcagcaatttgtcatagacatgttgcccagcagtcagagatttaccatgtagtttgaaccatagctcaaccacgtctttcagggttcgacgatccactgattcgcccagccatggctttgattcggtttcttccatagtgtgacgctcaaaagccagagcttcgcctttggtggcgaattgtttacgcacacgacgcccacttcgtccggcggggtaacattcgcaaagccatttccctgtggtgagttttcgtactgccataaaaaatgccctccagtagagagcatttttactgtatgtataaccagtgtcaatgtatgaaatcctacgaccatacatctcactgaagccataatgaagttggctattctttttgctatgtgagcatgtaacttttgcggttaacctgcggctcatttttattttagacgcagatataaaagcaaaagttatcgtgagtttttagtacagatttttttggatttactaatagttccatcattgcaaacgaatttgccatctgaggtacagtgagaaacacctccctttttccctgagcagggataatttctagcataggtagttagtgggtttaataacaaagaacatgacaaaaccacaaaaaataccttaccaagcatagtttcctcccggtactatttaacatacttgactgttaaacttataattttaccaattatttcaatgtcttctatcttacattcgaaggctctgtttccaccctcgacgaagattcttccaccgggtaaacgagtaatgtcacggatcgttacttcgccatcaatacttattacccatttaccatcacgtatatcatcaaattctttatcacaaataaattcagaattgttatctgtgatgacaaaaggttttttaaacgtagagggtagaaatcccttatcaaaaatataaaaaccgtcttcacgcaaggcaccatcagataatacatatttagcaacttccatagtatttgtattacctgaagtttgctttgaaccatgtccggttgtgagccaattaagcgaggtgcccgtttcaagggcgcactggattacccattctgctgggaatgagtcacgcatgtagcgtgtggcgagtgtacttttagagattcctaaatgatcgcacaacgcctgtcgagttttgaatccataagcttctaccatgcgctctatagcgcctcgtccgcctttctccaaattcatggtcactccaagtgaacttttatcttgacgatttcattgcgcgatcgtatgtttatggtgttcacaaaatacaaacgatccgtattcgtcctgattaatcatcattaaacgaggaatgttgcatcatgagacctaacatttcaatcactcttaccacgcctcatgtgactattgagcgctatagcgagctgacagggctgtccatcgataccatcaatgacatgttggctgacggacgccttatctgtcaccgtttgcgcaaagataaaaaacgcgaaaaagtgatgatcaacatagcagccatgaccgttgatgcgctttcagaatgcaatctaaaccttaattagttcgattctgaaatacatcagaggcattgaccatgtttgattaccaagtttccaaacatccacattttgatgaagcctgtcgtgcatttgcactgcgccacaatctggtgcaactggcagaacgtgcaggcatgaatgtgcagattctgcggaacaagctgaacccagctcagcctcatctattaaccgcaccagaaatctggctgcttaccgatctgactgaagattcaacgctggtagatggttttctggcacagattcattgtctgccatgtgtaccgattaatgaggtggcaaaagagaaactgccacattacgtcatgagtgcaaccgcagagatcgggcgtgttgctgcaggtgcggtatctggcgatgtaaaaaccagtgcaggtcgtcgtgatgctatcagcagcattaactctgtaacacgactgatggcgttggctgctgtttcattgcaggcccgtttacaggctaaccctgcgatggcgagtgcagttgataccgtgaccggcctcggtgcttcattcggtttgctgtgaggtgcttatgctgacgaaagaaccatcatttgcatcgctgctggtaaagcaaagcccggcaatgcactacggtcacggctggatcatgggtgaggatggaaaacgctggcatccatgtcattcacaagatgaattgctgtctgaattgaccacgaggaaacggagaaagtcaaaatgtatgcagcggaaagtgaagtggtttatcagttttgttacagaggggagagttattcagtacctgaagatgatttgctctgttgttatccgtcgttgtcgggcgatggcagttactttttcacgctaaaggatgggacgtttttacggggagagcaggttaaagagacggtacgaaaaaatgtatctccctttgagcgttaccgtaagaacaaagaacgataggtgcgtttgggggatatgaagtatggcaattaatggcgctgcggcgactgttccattaagccccggagaacgcctgaatggacttaatcacattgcggaattaagggcgaaagtatttggcctgaatattgagtcagagcttgagcggtttattaaagatatgcgtgatccacgggatatcaataacgaacaaaataaacgggcactggctgccatattctttatggcaaaaattccagctgaacgtcatagcatcagcattaatgagctgaccactgacgaaaagcgggagttgattaaagcaatgaatcattttcgtgcagtggtgagcttatttcccagacggctaaccatgccgaattaaccaactaatgaaattaatggcgtaaacccgccgggcatccctttatctaaattcaggagaattgattatgcgtaatattgaaaccctctcgaccaaaaccggaccggatgacgcagggcttaatattttactgacagaggctcgtctggaagaacgccgggcaagggctgaagcaatggtagctcgccttgatagcctggcgtgtcatatcacatcccgccagctaacccacgtcgaagcggcagaactgcttcgtgtgactgctgaagcaatccagaacgaagcgcaggagatccactaatggctgatgcaatggatctcgtacagcagcgcgttgaagaagaacgccaacgccatatccgtgctgcccgtgccaaaacgccgggcgtgtcccgcgtgctttgcattgagtgtgaagcgccaattccgccagcacgccgccgtgccattccgggtgtgcagctttgcattacctgtcaggaaatcgcagagctgaaaggcaaacattacaacggaggtgctgtatgagcaccatcctgaaatgggcgggaaataaaactgtcataatgtccgaactgaaaaaacatcttcctgctggcccgcgactggttgaacctttcgcgggttcctgtgctgtgatgatggagacggattatcccagctatctggttgcggatattaatcctgatttaatcaacctctataaaaaggttgccgctgattgtgaatcgtttatatctcgcgccagagttttatttgagatcgcaaacagggaggtggcttattacaacataaggcaggagtttaattactcaactgaaattactgatttcatgaaagcggtatatttcctgtatctcaatcgtcatggttaccgtgggttatgtcgttataacaagagcgggcatttcaacattccatacggtaattataaaaatccgtatttccctgaaaaagaaattcgcgcatttgcagagaaagcccagcaagcaacgtttatctgcgccagctttgatgaaacgctggcgatgctgcaggtgggggatgtggtgtattgcgatccgccttatgacggtacgtttttcggctatcacactaacggcttcactgaagatgaccagtatcacctggcatctgttcttgaatatcgatcatcagaaggtcatccagtcattgtttctaacagtgacacatccctgatccgttcgctgtatcgaaatttcactcaccactacatcaaggcaaaacgcagcatcggcgtgtcggctggcgagagtaaatctgcaacagaaatcatcgctgtttctggggcgcgctgctgggtgggatttgatccttcgcgtggcgtggatagttctgccgtgtacggagtgcgtgcatgagccatgctgatatgaacaactgcagcggctttaacgaggccgccgcagcattctcatggaacagcccgaaaaaggctattaacccttatctggacctggcggaagttgcgccggtttctgcgctttcaaacctgatcactctgtacgctgccgataacgagcaggaacaactgcgccgcgaggcactgagtgatcaggtttgggagcgttatttctttaatgaatcccgtgatcctgtccagcgcgaaatggagcaggataagttcattagccgggcaaagttggcgcatgagcagcagcgttttaacccggacatggtcattctggcagacgttaacgcccagccttcccatatcagcaggccgctgatgcaacgtattgaatacttcagcagccttggcaggccaaaggcttattcccgctatttacgtgagacgattaagccatgtctggaacggctggagcatgtacgcgacagtcagctatccacttcttttcgctttatggcaagccatgaagggctggacggcctgctgattctgcctgaaatgagtcaggatcaggtgaaacgcctgtccacccttgttgctgcgcatatgagcatgtgccttgatgcagcttgtggcgatttgtatgccaccgatgacgttaagccagaagaaatccgcaagacatgggaaaaggtggcagcagaaaccctgcgactggatgtcataccgcctgcgtttgagcaactccgccggaaaagaaaccgccgtaaacccgtgccctatgaactcattccgggttcgctggcgcgtatgttgtgcgccgattggtggtaccggaaattatggaagatgcgttgcgaatggcgggaagagcagttgcgtgctgtttgcctggtcagcaaaaaagcatctccctatgtcagctatgaagccatgatgcataaacgtgagcagcgccgtaagtcgctggagtttttccgttctcatgaactggtgaacgaagacggcgacacgctggacatggaggatgtggtaaacgccagcagcagcaaccctgcgcatcgccgcaatgagatgatggcctgtgttaaaggtctggagcttatcgcggaaatgcgcggtgactgcgccgttttctacaccatcacctgtccgtcacgtttccattccacgctaaataacggcaggcccaacccgacctggacaaatacgacggtaagacaaagcagtgattatctggtcggcatgtttgctgcatttcgtaaggcgatgcacaaagccggattgcgctggtatggcgtgcgggtggctgagccgcatcatgacggtacagttcactggcacctgttgtgttttatgcgcaaaaaagatcgccgcaccattactgctttgttgcgtaagtttgccattcgtgaagaccgcgaggagctgggtaataacacgggaccacgctttaagtctgagctgataaacccgcgcaaaggtacgccaacaagctacatcgcgaaatacatcagtaagaacattgacgggcgtggtctggctggcgagatcagcaaggaaacgggtaaatccctgcgtgataacgctgaatacgttaatgcctgggcgtctctgcatcgtgttcagcaattccgcttctttggcattccggggcgtcaggcttaccgtgaactgcgattgctggctggtcaggcggcaaggcaacagggggacaaaaaagcaggtgcgccggtactggataacccgcgccttgatgcaatcctggctgctgctgatgctggttgttttgccacctacatcatgaagcagggcggcgtactggttccccgcaaatatcacctcatcagaactgcttatgaaatcaacgaagaaccgaccgcatatggcgatcacggtattcgtatttatggcatctggtcacccattgcagagggcaagatctgcactcatgcggtgaagtggaaaatggttcgtaaggccgttgacgttcaggaggcggcagccgaccagggcgcttgcgccccttggactcgtggcaataactgtccccttgctgaaaatttgaaccaacatgagaaagataaatcagcagatggggataccagaacggacattacctgcatggatgacaaggaattgcacgattacctgcacagtatgggcaaaaaagagcaccgggaactggcagcaagattacgcctggttaaaccgaaacggcgtaaagaccacaaacagcgaattacagagcatcagcgtcagcagctcgtctatgaactgaagtccagaggatttgatggcagcgagaaagaagtcgatttactgcttcgtggcggcagtattccgtcaggagcaggcctgcgtatcttctatcggaaccagcgtttgcaggaagatgataagtggcgggatctgtattaattacgcgggttaacaattcgtgctcttaataataccaggcatatcaggctgatgaacgtaaaaaaacgttttacatcagtaagattattatatactgtaaatataaacagtggttatatgtacagtattgcgtatggtgttataggaggaaagatgcaggactattttttggagtctttgaagctccagcgcattgatttttttcttaagcttgtagcggctagtgagtgtagcgatgaagagaaggggctggctctgcagtgggtttctgaattgactgatgagttgatggcgaaaattcgaagccatgaatacagtaggtcgatggatgtaatcagttgagcttgtttcgttaggacttgataagggaaccgaaaaggggcattaagcccctttctcataagttgatttagttgttccccaaagagccggccatggctgcatatttaatttcttcgctgggtatttcaggatgtagttgaatttgcctgatgacatagccaggaacttcgtcactccacagtttcgccgcgtccttacagaccttatacgcgaagtctctattctcaaaggcataggattttccgtatgcatattgctgacaggtatgaacataagctccgaagtcgccgtctttatctggcaaagcacatccagccaaggctatgatgattgctactaacgtaaaggagaaagttatacgtttcatggtctctttctaagcgtttagcattatttaactaaggggtatctgccgtgatttggtagtccctgatatatattctcagggactatgctgaagtagatttaatttcgattatttagaaaggtacttatctctaagttgattcagtctgtcagcatcgcgttctgaaaactcggcgtcaccatagatcgatttcccatctgcgtcttcaaggccaatgactgtgacggtaaatatagcatcagccggaactttaagttttccccaatcagagtatctattaggggctaatttccagttggctttctcacctggttccagacctccagaaattttatagttgaagacgtcagagaaccaagggacgcttcttcctgggctggcaataacacctttgaagaatactctggcaaccgctttgtctgttccgttttcaacgctaatatccagaattggctgatcattgccgtaatcctctttctggaaataaaaacgggaacgttcgaccttgaaggctttcattttttccgcagcctgtgttgcagaggtttgtttggcttccagttcttttatttcttgcagagcctgttctttctctctcttctcacgctcaaggcgaatagtttgtgcgtaatttataacctcatcaccagttttaccttccaacgctgacttaatttttgtttcgtagacgtccccagaagacgttccagcctgcattagctctctcatgttgatttggctaaaggcaacgactttaactgcatcatcaaactgagcttttttatctgcaggtaaggactctcttactttttgaatggactctttcatcgactgatcgcttgatgcatcgatcttcggtttgtcacaagcagtaagcagcagagcaaaagcaattacgccagttaatttcttcatatccctatcccaatcgtaaaaaaacaaggctaatcctaacaggattagctggcatgacaaactcatagccatataggtgtgctgtataaattagcgggatgagaaagcctgcgcagaccctcatgttgaaacttgattttagctcaaaagagctgacactaaataactgcgcggaataatgctccacttcggttagcccttgctgggtaaggcgtggggccgttttcttcgcctgatcctgctgtatctggcctacagtatgttgcccttacgcgacatgccacatgtcagtaaacggcaggtgtagcagtattagacgcagctatttagtgtgtattaagctggctcatatttatgactggtttcaaagtttgaccgattttcatgtcatgcatgtctatgctgcatgagttcgcatgatcgtttgaggatcggtttggctaagacatgccagaactggcgggcttttgcttatgtcatgcaggtgcatgaaaaccactacataaagcgggcaggcgtggcggggatacgagcgcgcgctaagtcatataagagttatatattgatttgattgctggacatgcatacagtatcgctctatcatctaataaatcttagagtatttgacaatgtttggataaaatggaacctaacttattcataatccgctaaacagggatgtcagatgccataccaattggtagagcttagccccgtagctaacgatcttgaacagttaggaaccaaagagaagttttggttctatttctccgatgacactgtaaatttgcagttgtttaagtactctaggctaggtactggcgagcattggtctgaaaagtgtgctgctgagttatgtcatttgcttaacattccacatgctagctatgatttggcgcgatacaatggtcgattcggtgtggtgactcagaatatcattccatctggtttccggatggtaatgggaaatgaagtgcttcacagttcgacattcgattatcctgggcctttacaagccggggaaaagccggtaagggtcagagaacacactgtcacaagggtattgggttgtttagatagggaatctatcaagcctcctccgagtgtatatgatctaaccgggctaaatgcagcagatgtattttgtggatttttgatgctcgatgcacttgtgagtaatcaagatcgccatcatgaaaattgggcgatcatgcttaacaatgaaactggtgagcagtttttgtgtccaacatacgatcatgccgctagtttaggaagggagatgttagatgatgagcgtaacgaacggcttaatactaaagataaaaatcgacaaatcccatgttttgtaagaaaagctcgctctgagctattcaaagcaaaaactgataaaaagcccttgctgaccgttgaagcatttcaacatgcagttgaagggagagttgccgctcgcgaccattggttaggtaagttgagcgttttaacagaagattccattacagatgtgtttaaccaagtgccttcatcgtgtatatccgacagtgcacgtagatttgcaacgttaatggtaatggaaaatcgcagaaggttactagaatgactaatacaaactccgtttacgtcgcatggcaggcaccagataccagagactggcatgttgttggtaacttgcaagagcgcaaatcggggtatgttttcaggtataccaaaggtgctcttaaatctactaaatttacaaagtttagcggcatgagtgatgttcgtgaaacttatgtttcggaagaattgtttcctctttttaaaaatcgccttttatcaccgagacgtccagagtatccgagtttcattaaatggcttggatttgaagaagataaggtaaatcctatcgatattcttgctcgctcgggaggcttacgaagcactgatcagctgcagattttcaaaaaaattgatgttgattctgatggtaactttgagcattttttcttcttacatggacttggttacttaaatagcttagctaatgctcgtgtatctgaattgaaaccggggcaaattttgcgtctttgcttggatcttcaaaatgaatacgatggggatgctgttgtcgttcgtgcagataaatcagctgaaatcgttggttactgccctaggtatttaagtaatgatatcaagaagatgttattggatgatccaaaatcaatcactttaacggtcgaaaagattagcgatgatgctcctcataactatcggttattatgtaaattatcaggagtactaagccaagcctgtcaatcgacgctgattcctcaggatgagtttgaacctattgagtaaatgaagaaaagccaccaaacggtggcttttcttattatgggactatatctagcgagtaggtattaaactgtatcgcctccttgccaagccaatcattcatctcctgtaatcgcttttgtagtggcattagctcatttcggacgaatacacggcttgccttctccacatccccaaaccccccaacattattcggcataatccccatcatttgcggtggcacacgatgcgccgccatcatgtcgtcccggcttacgttcttgatgttcagaaactcatcctttgccgccacttctgacagcgggatgatctgaagcccgtcctttttgccgttaggcgagtacataaacaggttgcggaagttgcccggacctttggcgcttttcatcgcgttgcggaggttgttcacatcctcctggttctgagcggcatcggtcatgtacattatgaatcctgcatggctgccattaatataatatttgcgtcggaacagcgtggcggactcgttgagcagggctgacggaatggcagaaagatagccgggcaggccgtagatctcctggttgatatcgggttccatcagatgaaagatgctgcctttcgtgaactgatacggctgggttgtcataccgtattgcacaaaccagtaggtatccaggtctaacccgcgtcgggtgtattttgccagagcaggctcaagggcgataatttcaccgaaccggttcgtgcgtttctccaggtaggcgttaccaaataccagatagtcctgcacaaaacgtgaaaaagcctgctggctgagcagcgggtgagggatgtaggtgctggtcagaatgttgcatttcaccgcaatcggtgagctatgatgcacggcggcgcggaaggttcgcgccagtccgtcgaaactcactggtggctcataccagcggtccatctgtacgcattccacatagtccagtaattcgcggcggtccagaacaggaacgggatcgccgaagctgaatgcttcggctgaagtctggcttttatgctggatctgattcatcgccgctgcgcggtttttcttacgctttcccatcaaaaaatctccacaatattgctggtattggcggactcgccttgcagtggttcgttaaacagtgcgtgcatcgttgcccaggccagatcggcgtggctggcttcttcgctgcggctggcttcataggtcgggcggttgccactggcggtggtggcgcgacggattgccataaatgactgcgctatgtcggtgtgtccggcgtcaaactccagacggcggtggctgataatgtcgtaggccttgagtaccagagcgtttttaacgttggggttgtagacaaactcccggacggcaggaaagaacgctttcacgttctcataaaccccgtgaccgacgcctgtcgagtcaatgccgatataggtcacgttgtactgctcggtcagttttttgattgcatcagcctgggcgcggaagtccatcccgcgccactggtgacgctcaagaatgcgaaacttaccgcctggcacggctggcggtgccaccaccacgcatccggcgctgtcgccgttctgcgtacctttcgccgggtcataaccgatccacacctcgcgccagccaaacgggcgcagggccagtgcatgaaagtcggtccagacttcccaactgtccaccatgcacgcctgcagttcgctgagcgggaacacggacgcgagatcgtccacgaactcgcacatcagcaggttctggtattcgtccgggctgtactccatgcgcagctggtcgaggtcgaacaggttacagccgccgcgcaccgcatcttccacggtgactatctggcggtattgcccgtctgcgcacagcaagccgggggccagattgttgtgggacaggtcgatgtccaccttatcggctttgttgcgcccacggttaaacagcgcgccggaccagaacggataagcactgtgtgtaaggctggatggcgtggaaaaataggtttgtcgccattttttgtgaatagccataccggaagccactttgcgcagctcctggaatttcggtatccagaaatattcatccagatacaggttgccgtggtaactctgggccgtgcgggcattggtgccgaggaagtaaagcgtggccccgttgggaagcaccatcggatcgcctttcagctccacctccacttctttggcgaagtcgatgatgtactgtttaaagacgtgggcctgtgccttactggcggaaaggaaaatctggttacgtccggtaagcagggcgtcaatcagggcttcacgggcaaagtaaaaggtcgcgccgatctggcgtgacttcagcaggttgcggatgcggttggtttttccggcttcccaccagtggcgctggtagttgaacatggaggaatggaaaatttcttccagcttctcaatctgttcatcggtgaaaacgttcttttccggctgacggcgtgggcctttgttgcggttggcgacgttagggtttaagtcggcttcgttgccgccattgttaaacttgccgatccgcgcgtggcgttccgactggcgcgccagcaggtcaatctctttgaaatctttcccttctttgtgctccttcataatgagctggcagtagcgtgcggcggtggtgagctgcatctgatccagcggcccatagtcgccccacttgtcgcgttttttccagctgtgaacggttgcaactttttcgcccagcatttcagcaatgcgggctacgcggtatccctgaaagtacagcagcatggcctgccgacggggatcgagatctgcgggtgtcagtgtggtgttcatggcacaaacctacagccttgaatgaaggctttccccgcctgcggtttgtgtggttgtcggtacaaataccgcgcattgtttcactgcccccatcaccgcaaccataaggctccagtaagttttttctaacggagcacggctcatgacagtgaaagcaaagcgttttcgcatcggggtggaaggtgccactaccgacggacgcgaaatccagcgtgaatggctggaacagatggcagccagctacaatccggcggtgtataccgcgctgattaaccttgagcacatcaagtcttatctgccggacagcacctttaaccgctacggcaaggtgacggcgctgtttgctgaagaaatcacggaaggtccgctggcgggcaagatggcactgtatgccgacgttgagccaacggagtccctggtggagctggtgaaaaaaggccagaaattattcacctctatggaagtcagcccgaagttcgctgatacgggcaaagcctacctggtcggcctggctgccactgatgaccctgccagtctgggcactgaaatgctgacattcagcgccagtgcagcccataacccgctggcaaaccgcaagcagaatcccgccaatctctttaccgccgcagaggaaacggtgatcgaactggaagaaatccaggaggacaagctgtccctgtttgcccgcgtcacggcactgttcaccaaaaaagagcagtccgacgatgcccggttctctgatgtgcataaggccgtggagttggtcgccactgagcagcaaaacctgagcgcacgcaccgaaaaatccctgtctgagcaggaagaacgtctgtctgagctggagactgccctgcaggcacagcagacagcctttaacgaactggtgaataagctgagtcatgaagacagccgccaggactaccgccagcgtgcaacaggcggtaacgcccccgctgacactctgaccaattgctgatggagcacaaaacccgatgaagaagaatacccgctttgcttttaacgcttacctgcagcagctggcgcgtctgaacggtgttgcagttgaagaactgtccagcaagttcaccgtcgaaccgtccgtgcagcagacgctggaagaccagatccagcagtccgccgctttcctgacactgattaacgtcacgccagtgactgagcagtccggtcagttgctggggctgggcgttggcagcaccattgccggaaccactgataccaccgcgaaagagcgtgaacctgtcgatccgacgctgatggttgatgtggaatataaatgcgagcagactaactttgacacggtgctgacctacgcgaagctggacctgtgggcgaagtttcaggatttccaggtgcgtatccgtgacgccatcgtgaaacgtcaggcactggaccgcatcatgatcggctttaacggcgtgaagcgtgcgaaaacctccaaccgtagcgaaaacccgctgctgcaggatgtgaataaaggctggctgcagaaaatccgtgaggatgcaccggatcacgtcatgggcagcaccaccacgggcggtgaaactacaccgggtgcggtgaaagtcgggaaaggtggcgaatatgccaacctagacgccgtagtgatggatgccgtcaatgagcttatcgacgtggtttaccaggacgatgacgatctggtggttatttgcgggcgtgaactgctgtctgacaagtatttcccgctggtcaacaaagagcaggaaaacagtgaaaaactggctgccgatatgatcatcagtcagaaacgcatgggtggcctgcaggccgtgcgtgcgccgttcttcccgccgaatgcgctgctaatcacccgtctggataacctgtccatctactggcaggaaggcacccgccgccgttcagttatcgacaacccgaaacgcgaccggattgaaaactttgaatccgttaacgaagcctatgtggttgaggactaccgctgcgccgcactggtggaaaacatccagattggcgatttcagcgccgctgcagcagaagccggagcgtaacctatgagcctgagtcccgcacggcagcatcgcctgcgcgttcaggctgaacaggccgcccgcgagggcggcagcgttcgccacgcatctggctatgacctgatgctgctgcaactggcggaagaccgccgccgtctcaagggcgttcagtccacggtcaaaaaagcggaaataaaggtggagctgctgccgaaatatgccgcctgggcggagggcgtcctggctgccggaggcgctcaacaggatgacgtgctgatgtacgtgatgctgtggcgcattgatgccggagattatgccggggcgctggagatcgggcgtcatgccctgcgtcatggctgggtgatgccgctgggtaaccgcaatgtgcagaccgtgctggcagaggaaatggcagatgcagcgcagagcgcaatgcttgccgccaccggctttgatgccgatctgttgctgcagacgctggagctgacagacggtctggatatgccggaccagtcacgggcgcgtctgcataaagcgattggcgctgttctgagtgaaagcaatccggcttccgcccttaatcatctcaaccatgcgttacagctcgatccccgctgtggcgtgaaaaaagacaaacagcagctggagcgcagactgcgcaatgacagccgctgacagaacgtgcccccgcgcacgggcggcacgggatggcgaaaggcactgccacatcaaaaccccgtccaccgccctttatttcaggagaaagcagcatgaagtttgttgcgccagaacaggcaccggaacaggcggaaatcatcagaaatacgccgttctggcctgatgtggacctgtcggagtttcgcagcatgatgcgcactgatggcacggtgacgcagccgcgtttaaagcaggttgcgctgtcggcaatttcggaggtcaacgcagagctgtatgagtttcgcagacgccagcagatgctggggtatgcctcgctggcagaagtcccggcggaacaactggacggcaaaagcgagcgcattcagcactatttcaacgcggtttactgctgggcacgcgccatgctcaacgaacgttaccaggactatgacgccacggcatccggtgtgaagcggggcgaagaactggcagaagccagcggtgatttgtggcgtgacgcccgctgggccatcagccgggtgcaggatgcgccgcactgcacagtggagcttatctgatgaaagtgcgtgcgcatcagtatgacacggtggacgcgctttgctggcgtcattacgggcgcacgcagggtgtcacggagcaggtactgaaggcaaatccggggcttgccgaatacggcccctttttacctcacgggctgcaggtgaagctgccggacattccgaccaccaccaccgtgcagaccgtccagctatgggactgaattatgacgcttgagcgaatcagcgcctttatcacgtattgcatcgccgtcgtgctggcctggctgggcgatttgtccatcaaggatgcctcaacgctgggcggcctgatgattggtgtgctgatgctggctatcaactggtactacaaacacaaagcctaccagcttctgcgcgacgggcagatctcgcgggaggactatgaatccatcaatcgttaaacgctgccttgtcggggccgtgctggctattgctgccacgctgccgggttttcagcagcttcacacctccgtggaggggctgaaactgattgccgattacgaaggttgtcgtctgcagccgtatcagtgcagcgcgggtgtctggaccgacggcattggtaatacgtcaggcgtcattcccggcaaaaccattacggagcgacaggcagcagaagggctgatctccaacgtgctgcgtgtggagcgggcgctggaaaggtgtgtgaagcaacagccgccgcagaaggtgtatgacgctgcggtgtcgtttgccttcaacgtgggaacgggcaatgcctgcagttccacactggtgaaattactcaatcagcggcgctgggcggatgcgtgccgacagttgccgcgctgggtttatgtgaaaggtgtttttaatcaggggctggataaccgccgtgcgcgggagatggcctggtgcttacagggagcaaactgaaatgaaaaagaaattaatcagcggactgtttctgatgttatggatggcgctgttaatcgcagcaatggtgtatccgcaggggatttttccggtactggcagcgtccggcgtttgggtagcctgtttgctgacatgggcggtaattccggtagcactggctgcgttaattaagaatggcccgctctggcaggagttaagggcatctttgctgaagacaattacccgaaaagaaaacgtatttaccagttgggtgatgcgattgctgattgttgtaagtctcgcctggacggggtgggctattaccctggtcttttatctactgaccgttattgccttctggatcacccgtaatcagatggcgcaacaggtagcagcatgaaccggttgctgctggttgtgctggcgttattactggcggcgctgggctggcagacgtggcggctggctgatgccagccagaccatcagcacgcaggcagacgagctgcagagcaaaagccaggcactggcaaagagcaacagccagcttatcagcctgtccattctgactgaaaccaataaccgggagcaggcgcggctctatgccgaagcagaacagaccagcgcacagctgagacaacgacaacgccggatcgaggaactgaaacgtgagaacgaggatttacgccactgggctgatactcctttgcctgctgacattatccggctgcgggaacgtccggcactcaccggaggtgcagcttaccgtcagtggttgtccgcgagtgacgccgtgtcggctggagcaggcagcaccgcgcactaacggtgatctgaatgcgttgctggatgaaacggaggccgcctgggcggtctgtgcagacaaagtggacatgattattgcgtgtcaggagcgaaacagtgaacaaaccacaatccctgcgccacgccctcaataaagcggtgccttatgtccgcaataacccggacaaactgcatctgtttgtggataacggttcgctggttgccacgggggccagctccatgtcatgggagtaccgctataccctgaacgtggtgatagaggatttcagcggcgaccagaatctgctgatggccccggttttactgtggcttcgggataaccagcccgatgccatcaataacccggcgttacgggaaaagctattcacctttgatgtggatattttgcgcaacgatgtctgtgatatcagccttaatctgcaactgacggaacgtgtgctggtcagcactgacggcagtgtgtcgagcgttgaagctgtagcagaacccgatgaacctgaagaaatgtggacggtgaaacgtggctgaactgcagaaggtggacgactggctgagtgccttgctggcgaatctggaaccagccacgagaagccgcatgatgcgccagctggcgcaggaactgcgccggacacagcagcagaatatcaggatgcagcgcaatccagatggcagcagttatgaaccgcgcagggtaacagcacgcagcaagaaagggcgcatcaaacgtcagatgtttgcaaagctgcgcaccacaaaatacctgaaaactgccgccagcgccgactctgccagtgtacagtttgaaggcaaggtgcagcgtattgcccgtgttcaccattacggcctgcgtgatcgcgtcagtcgcaaaggaccggaggtccgttacgcagagcgtcgcctgctgggtgtaaatgatgatgttgaggcaatgacccgcgacatgattctgcaatggctggcggggtgatctttgtatcagcactgatacaagttgcagcattgccgcctttcttcccctgatggcaacctttccctatgaacgcacaattaaccgaaatcatgcgccttatcaccaatctgatccgcactggtgtagtcaccgaagtggaccgggaacactggctttgtcgggtgaaaacgggcgaccttgaaaccaactggattaactggctgacgctgcgcgcgggtaatgcccgcacatggtggaaaccatcggaaggtgagcaggtggtgctactgagtctgggcggcaatctggaaactgcctttgcgctgcccgctgtctattcgaatcagttcgcaccaccgtcgacgtcggcagacgcctgcgtgacagaacatcctgacggtggctggtttgaatacgaacccgccaccgggcgctggtatgtcaggggcatcaaatcaatggtcattgaggccgctgacaacatcaccatgaaaaccagtgagtttgtactggaggctgaccgcacgcgcattaacagcgaagtggtgatcaatggtggcgttacccagggcggcggagcgatgagttctaacgggatcgtggttgatgcgcatcagcatactggcgtcctgaaaggcggcgatacaaccggaggcccggtatgacgctttatagcgggatgaacaataccagcggcaaagtcattactgatattgaccatctgcgccagtcggtgcgggacattctgctgacgccgcagggtagccgcattgctcgtcgtgaatatggttccctgctgtcgtcgctaatagaccagccacaaaatccggcattacgcctgcaggtcatgtcggcagtgtatgtggcgctgagtcgctgggagccacggctgacgctggattccatcaccatcaacagccattttgacggttcaatggtggtggagctgaccgggcggcgtaataacggtgtacctgtttccctttccgtatcaacaggagcagagaatggcagtgattgacctttcgcagttgcctgcgccgcagattgtggatgtgccggactttgatacgttgcttgccgaacgcaaggcagaatttgtggcgcttcatccgaaagatgagcaggaagcagtgagccgcacactggaactggaatctgaacccgtcaccaaattgttgcaggagaacgcttatcgtgagttgcttctgcgccagcgcattaacgaagccgcgcaggcggtgatggcggcttatgccatagggagcgatctggaccagctcgctgccaattacaacgtgaaacgcctgacggtgacgcctgctgataatgacgctgtgccgcccgtcgcggctgtgatggaaagtgatgaagcgttacgcctgcgtgtgcctgcggcttttgaagggctttcggttgcggggccaactgccgcttatgaatttcatgcccgaagcgccgacggtcgggtggcggatgccagtgcaaccagtccggcacctgcagaggtggtgctgactgtcctgagccgcgaaggcgatggaacagcagaaaaagacctgctggacgtggtggaaaaagctctgaacagtgagaacgtccgcccggtggctgaccgtcttacggttcgcagcgcagaaatcatcccgtaccgggtggaagccactatttttctctatccgggaccggaagcagagccggtaatggcagcggcaaaagccagcctgcagaagtacatcgccagtcagacgcgtcttggtcgggatattcgccgtagcgccatctttgccgccctgcatgttgagggtgtgcagcgtgtggagctggcttctcctctggcggatatggtcctgaacaaaacacaggcggcatcatgtacgcagtggagcgtaaccaacggaggaacggatgaatagtctgctgccaccgggttcaacaccactggagcgccgattggcgcaaacctgcagcgggatttctgatctgcaggtgccgcttcgtgacttgtggaatccggcaacctgtccggtcagtttcctgccttatctcgcctgggcgttctctgtggatcgctgggacgagggctggacagaaagcgtcaagcgccaggtggtgaaggatgctttttatattcatcagcataaagggaccaccagtgccgtgcggcgggtggtggagccgttcggctttttgatccacattattgagtggtggcagaccggagaggcaccgggcacgtttcgcctggatatcggcgtgcaggaccagggcatcactgaagatacctatctggaacttgagcgactgataagcgatgccaaaccatgtagccgccacatgatcggcatgtccatcaatctgcagaccagcggcccgcattgggtgggagccgccagctatcttggcgaagaaatcacgatctatccgtatatcaacgaaacgattatttccggtggcaccgcgcatgaaggcggggcggtccatgttattgacacaatgagagtgaatccatgagcacaaaattttataccctgctgacggatattggcgcggcaaaacttgccagcgccgccgcgctcggtgtgccgctaaaaattacccatatggcggtgggcgatggcggcggagtattgccaacgccggacgcaaagcagacggcactggtaaatgagaaacgccgggctgcgctgaatatgctttatatcgacccgcagaacagtagccagattattgctgaacaggtgatccctgaaaacgagggcggttggtggatacgtgaagtgggcctgtttgatgagtccggggcattgattgccgtgggaaactgcccggaaagctataagccgcaactggctgaaggcagcgggcgtacccagaccgtgcgcatggtgctgattaccagcagcacggacaatatcaccctgaaaatcgaccctgccgtagtgctggcaacccgcaagtatgtggatgataaggtactggagctgaaggtgtacgtggatgacctgatggcaaaacatcttgccgcaccggacccgcattcacagtatgcacagaaagaaagtcctacgtttaccgggacacccaaagcgccaacgccagcggcggggaataacaccacgcaggttgcgaccaccgcgtttgttcaggctgcactgacggctattattaatggtgcgccagccacgctggacacgctgaaagaaatagccgtagccattaacaatgatccgaaattcagtaccaccattaataatgcgctggcactgaaagcgccgctgttgagtccggcactcaccggaacgccaacagcccccacggcggcgcagtcggtcaacaatacacagattgccactacggcttttgtgaaatcggcgattgcggcaatggtgggttctgcacctgcggcactggatacactgaacgaactggcggcggcgctggggaatgatccgaactttgccacgacaatgcttaatgcactggcaggtaaacaaccgctggacaatacgctgactaatttgagtggaaaggatgtagcgggtcttctcgcataccttggtttgggagaaggttcggcattacccgttggtgtgcctgttccgtggccttccgccactccgccaacaggctggctgaaatgcaatggtgcggctttttctgctgaagaatacccggaactggcaaaggtttacccgacaaataaattgcctgatttacgcggtgaatttattcgtggctgggatgacggacgtggagtggatgccgggcgacaattattatcttcacagggggatgcaataagaaatattgagggattcgcagatggcgggatcggtatgtcttttgatgcaatcagaggggctttttatgatgcaggaacacgatctgcgagaatgccgaataacacaactgatataggcaaaaccgatgaccttggattcgacgcctctcgtgtcgtgccaacagctaatgaaaaccgtccacgtaacatcgcctttaattatattgtgagggctgcataatgaaacctgtttttgatgaaaatgggctggctacagtgccgggtgatatgcgttgttattattatgatgcagtaacgtctgaatatacgggctggtctgatgaatatattaatactggcgtaagtatgcccgcttgttccactggtattgacccgggcgaatacattccgggaagagtggcagtatttacgggtaagggatggagccatgaagaagaccatcgcaatgagaccgtttactcaactgaaaatggcgcagctgttacagtggattatatcggtgccatcaaagacggttatgtcacgctttcaccgttaacgccatacgataaatgggatggtgagaaatgggtgacggataccgaggcacagcatagcgccgcagtagaagctgcagaagcacagcgccagtcgctgattgatgctgcaatggcttccatcagtctgattcaactgaaattacaggccgggcggaagctgacgcagccagaaaacacccgacttaacgctgtgctggattatattgacgcggtaacggcaacagataccagcacagcgccggacgtcatctggcctgaactgccggaggcgtaggccattcaatatctggcgcaccggaagtatcgaccagttccagtgcgtccagataatccagccacaaattatattgcgccagttcctcacctttcaggcgaccaatcgccgctttaccaggccattgcttactgtttatgtattcgttgacctgattaatcaattgctgcttttccagttcggctgcggcaatttgttcctcatgagttggcggtggaatatcaatccatgcaggcattccgtcgatgacacctctgtattttccttctggtgcttccttcataaattcggcggcaacagtgtcgtcaatttcgattccatcatcgggccattcgccggattcctgataagcgattttaagctccacagggaaaaacgcatttttatcggcgctgaaaatatatttctgcatttctaccgtcctatcgaaatataactgaatctgtattgctgtgagatatcactggttgccacacgccacgctgaattactgatatgttcaaaatttacagacaaaacctgcggagcaggaatcgacgggtctgactgaacgttatcagacataacactgactgaaaccatcggctgattagggaatggtatagggaagtgtccactgataaagcgggtcgtgtttcctgaaaaagtgccaaactgaacaatatatccacctggtagcctgaaccatcccgaaccagaagcgaatgctcccatatccggtatctgattatctcctgtgcccacattccgttttgccgcttctcccaaaccaacgtttatgaaaatgcagagataacggctaactggcatcatctccggtttttattcagggggatgatcatgcttattggctatgtacgcgtgtcaacaaatgaccagaacaccgatttgcaacgcaatgcactgagctgtgcgggatgtgagcggatttttgaggataaaatcagtggcaccaagtccgacagaccggggctgaaaaagctgctcaggacactatcggcaggagacacgctggttgtctggaagctggacagactggggcgcagtatgcggcatcttgttacgctgatagaagagctgcgccagcgtggcgtgaatttccgaagcctgactgacagtattgataccagcaccccaatgggccgtttcttttttcatgtcatgggtgccctggctgaaatggaacgcgaactgatagttgaacgtaccagggcggggctggctgcagctcgtgctaaaggcagagtaggtggacgccgtcctaagttgaccagcgaacagtgggcacagattgggcgtttactcgaggccggagaatcaagacagcgtattgcactgatttttgatgtaggcgtttctatcatttatcgaaaatttccggcaaataagaacaataaatctccctgaatcagctttattttgattatccctgaaagcagacaaataccgtcattttgtgtgaataacggtacaactgcgcttagctgtttgtcaggcacaatcacttcaacatagggcgaagcctaatccaatcaggaggttcgccactatggctcaggattaccaccacggggtgcgcgttgttgaagtcaacgaaggcacccgatccattaccacggtgagcaccgccatcgtgggtatggtctgcacgggcgatgatgccgatgcaaaaatgtttcctcttaataaacccgtgctgatcactgatgtgctgactgccagcggtaaagcgggtgagtcaggcacgctggcccgttcgctggatgccatcgctgaccaggcaaaacccgtgaccgttgttgtgcgtgtgccgcagggtgaaacggaagaagaaaccacgaccaatatcatcggcgcagtgaccgctgaaggtaaaaaaacaggcatgaaagccctgttatctgcccagtcacagtttggcgttaaaccgcgcattctcggcgtgccaggccacgacaccaaggcggtagctactgagttgctgagcgtggcgcaaagcctgtgtggatttgcttacctgtcagcgtatggctgcaagacggtacaggaggcgatcacttaccgtgaaaacttcagccagcgcgaagggatgctgatctggcctgactttactggctgggacactgtgctgaatgccgaagcaacggcatatgccaccgcccgtgcgcttggtctgcgcgccaaaattgacgagcagaccggatggcacaaaagcctgtccaacgtgggcgtgaacggtgtcaccggaatttctgctgatgtgttctgggatctgcaggacccggcaaccgatgcgggactgctgaaccagaacgacgtcaccacgcttgtgcgtaaagacggtttccgcttctggggttcccgctgcctgagtgatgacccgctctttgccttcgaaaactacacccgcacggcgcaggtgctgacggacacgatggcagaagcgcacatgtgggcggtggataaaccgctgaatccgtcgctggcccgcgacattatcgagggtatccgcgccaaaatgcgcagcctggtcagtcagggctatctcattggtggtgattgctggctggatgagtcggtgaacgacaaagacacgctgaaagccggaaaactcaccatcgactacgactacacgccagtgccgccacttgaaaacctgatgctgcgtcagcgcatcaccgatcagtacctggtgaatttctccagccaggtcagcgcgtaaggggacaacatggctttaccacgcaaattaaaacacctgaacctgtttaatgacgggaacaactggcaggggatcgttgagtcgctgacgctgccgaaatttacccgcaaatatgagaagtatcgcggcggcggaatgccgggtgcagtggatgtggatctggggctggatgacggcgcactggatacggaattttccattggtggtactgagctgctgctgtttaagcagatgggcaaagccacggtggatggcatccagctgcgctttaccggctctattcagcgtgatgataccggggaagtgcaggccgtggagcttgtggtgcgtggacgtcacaaagaagtggattccggcgagtggaagacgggcgaaagcaacaccaccaaagtgaccagtaccaacagctacgcgaagctgaccatcaatggtgaggtgctctatgaagtggacctgatcaacatggtggaaattgtggacggtgtggacctgatggaagcgcaccgtaacgccctcggcctctgatgtatctgaacggcgtgggataccgcgccagaacccaatttacaggacagcaaaatgagcgataagaagactgaaaagaccattcaactggatactcccatcaagcgcggaaaaacggaaatcaccgaaattgtgctgcgtaaaccgcagtccggtgcgctgcgcggtacacgcctgcaggccattatggatatggatgtgaacgcgatgatgaccgtgatcccccgcatctccagcccggcactgactgcacaggaaattgcagagatggacccggcagatctcactgccatgtcggttgaggttgtcacttttttgttgaagaagtcggtgcttgccggtttaccgacagcctgacggttgacgatctggtggcagatatcgccaccatttttcactggccgccatccgttactgacgttatgccgctgaccgaagtgctggaatggcggtataaagcgattcagagaagcggggccaacgatgagtgataacaacctgcgtctgcaggtcattcttaatgcggttgacaagctcacccgcccatttcgatctgcgcaggccagttcaagagaactggctgctgctgtcaaaaaatcccgcgatgcaataaagcagcttgatcaggccgggagcagtctggacagcttccgaaagctgcaggcagaaaatcagaaattaggcgacaggctgaactatgcccgccagcgtgcaaatttgctcagtcaggaactgggagcgatggggccgccttcgcaacgtcaggttgttgctctgggccgtcaacggctggctgttcagcgcctggaagaacgccagaaaaagctgcagcagcagacggcgcttgtgcgtgctgaactgtaccgggcgggaatttctgcgaaagatgatgcgggagcaactgcccgtttagcccgtgaaacatcacgttataaccaggaactgtcgaaacaggaggcgcggctgaagcgactgggggaagctcagcgcaggatgaatgtggcgcgtgccagttatgcccgttcgctggaggtgcgcgatcgcatcgcaggagccggagccaccaccacggcggcagggctggcaatggggacgccagtgatggcggcagtaaaaagctataccagcatggaagatgccatgaaaggtgtggcaaagcaggtcaatggtctgcgtgacgataatggcaaccgcactgcacgtttttatgaaatgcaggatgccatcaaggctgccagcgaacagttgccgatggaaaacggtgcggtagacttcgctgcactggttgaaggtggtgcgcgcatgaacgtcgcaaaccctgacgacagctgggaagaccagaaacgtgacctgctggccttcgccagtacggcagcaaaggcggcaacagcctttgagctgccagcggatgaactgtcagaaagtctggggaaaatcgcccagctctacaaaatccctacccgcaatattgaacagctcggtgatgcgctgaactatctggatgataacgccatgtcgaaaggggcagacattattgatgtcatgcaacgtctgggcggtgtggctgaccgtctggattatcgtaaagcggcggcgctgggttccacctttctgacactgggcgctgcgccggaggttgcagccagtgcagcaaacgcgatggtgcgtgaattgtccattgccaccatgcaaagcaagagtttctttgaagggatgaatctgctgaaactcaatcctgaagttattgaaaagcagatgacgaaggatgcgatgggaactatccagcgtgtgctggagaaggtgaacgcactgccgcaggacaagcgtctgtctgccatgaccatgttgtttggtaaagagtttggcgatgacgcggcgaaactggcaaacaacctgccggaactgcagcgccagctaaaactgacagcgggcaatgatgcgctcggctccatgcagaaagaatccgacattaacaaggactcactttctgcgcagtggttgctggtcaaaaccggagcgcagaacaccttcagcagcctgggcgaaacgctgcgccagccgctgatggatattctgtacatggtgaaaagcgtcacgggagcatcgcgtcgttgggtggaagctaacccggaactgacgggcacactgatgaaagtagccgctgtggtggctgccgttaccgtgggcctcggcaccttagcggtggcgctggctgcagtgctggggccgctggcagtcatccgtctggggttctctgtgctgggtatcaaaacgttaccttccgttacggcagcagtaacccgaactagcagcgcgttgtcctggctggctggcgcaccactggcactgctgcgacgcgggcttgcttcatcgggcaacgctgcgggtttacttactgcgccgttgtcgtctttgcgccgcacggcatcactgacggggaatgtcctgaaaactgtagcaggtgcgccggttgcacttttgcggtctggattatccggtttacgtgctgttgctgtgatgtttatgaatccactggcagcactacgcggtgggctggctgccgcaggcgcggtgctgcgtgtgctcgcatccggcccgctggcgatgttgcgcattgccctgtatgccgtatctggtctgttaggtgctctgctcagtccgataggtcttgtggttactgcactggcgggcgtggcgctggttgtctggaaatactggcaacccatcaccgcatttctcggtggcgtggtggaaggattcaaagcggcggcaggtcccatcagtgcagcattcgaaccacttaagcctgtgtttcagtggattggcgacaaagtgcaggcgttgtggggctggtttactgatctgctgacgcccgttaagtcgacctctgccgaactgcagagcgcagcggcaatggggcgacgattcggggaggcactggcggaagggctgaatatggtcatgcatccgctggactccctgaaatccggcgtttcctggttgctggagaaactcggtattgtcagtaaagaggctgcaaaggcgaaactgccggaaagcgtgacgcgtcagcaacctgcgacggtgaatgcagacggtaaagtgatgatgccatcaggtggttttccatcatggggatatggttttgcggggatgtatgacagcggtgggtatatcccgcgcgggcagtttggcattgtcggtgaaaacgggcctgaaattgtcaacggcccggcaaacgtgaccagccggagaaatacagctgcactggctgccgttgttgccggaatgatgggtgttgctgccgcgccagcagagcttccaccgttgcaccctttggcatttcccgcgaaaggcggtgaagcgatggtgagtcgcgcagccactgtgtcgcccgttcaacggattgaggcaccgacgcagatcatcattcagacgcagccaggacaaagtgtgcaggatattgcgcgggaggtggcccgccagcttgatgaacgtgaacgcaggctgaaggcaaaagccaggagtaactacagcgatcaggggggatacgacgcatgatgatggtgctgggattgtacgtgtttatgctgcgcactgtgccgtatcaggaactgctgtatcaacgcagctggcgacatgcggcaaacagccgggtcaaccgacgtccatccacgcagtttctgggaccggacaacgacatgctgacgctttctggtgttcttatgccggagataacgggcggcagactgtcgttgctggctctggagcagatggcagaacagggaaaagcatggcccctgattgaaggcagcggcacgatttacggcatgtatgtgattgagggactgaatcagactaaaacggagtttttccgcgatggtatgccgcgccggattgagttcaccctgtcgctcaaacgggtggatgaatccctgtccgatatgttcggtgatctcagtgcgcagctgaataatttgcaggatacggtaacgtctgccttaagcgatatcagtaaaacggtgggagggctgctgtcgtgaatttcagctctgaactgcttaacaaaggcaacaaaactcccgcattcagcatcagtattgaggggaaggatatcaccactgtgctggataaccgcctgatgagtctgacgctgacggacaatcggggctttgaagcagaccagcttgatttggagctggacgacgccgacggaaaaatcgtgctgccgcgccgtggggctgtcattacgctggcgttgggctggaaggggcagccgcttttcccgaaaggagcattcacggtggacgagattgaacacactggcgcaccggaccgcctgactatccgggcgcgaagtgctgattttcgtgaaaccctgaatacccgccgtgaaaaatcgtggcacaagaccaccgttggggaagtggtgaaggaaatagctgcgcggcacaaactgaagatggcattgggtgaagacctgtcggataaacccgtggagcatatagaccagaccaatgagagtgacggcagttttctgatgcggctggcgcgccagtacggtgctattgcgtcggtgaaaaatggcaatctgttattcatccggcagggacagggtaaaagcgccagcggtaaaccactgccggtgatcactatcacacggaaggacggcgacagtcaccgctttaccctggcagatcgcggagcctacacgggcgtaattgccagctggttgcatacccgcgaacccgcgaagaaagaaagcaccacggtgaagcgtaagcgcaggactaagaagcagaagaaagagccggaagcgaagcagggcgattacctggtggggacggatgaaaacgtgctggtacttaatcgcacttatgccaaccggagcaacgccgaacgagcggcgaaaatgcagtgggaacgcttgcaacgcggcgttgcgtcattctcgctacaactggcggaaggtcgggcagatctctacacggaaatgcctgtgaaggtcagtggctttaaacagccgatagatgatgcggaatggaccattaccaccctgacacatactgtcagcccggataatggttttacgaccagtctggagcttgaagtgaggattgatgatttcgaaatggaatgattcttcgcaatggagaacttttaagtttgcaaaatggaataatgcggtatcattattgtgaatttagcaaaaatggggagagctcgaaaaatgatgatttgcccactgtgtggaagtgccgcccatactcgcagcagttttcaggtatcttcattgaccaaagagcgttacaaccagtgccagaacattaactgcagccatacttttgttacccatgaaacttttgttcgttcgattgcaacgccaaaagagtcaaatccggttcagccgcatccaatgaaatcaggacaggtggcgctctctctttgacgctgccgccattttgtcgccatcgttaaaaaacagtgtttctaacatcatgattttaaacagcttaaatttcaggcaacaaaaaacccattaaccttgctccagccgatctaccgaaagagggcggaaggtatgacctgcctattgctgttgcgcttctggccgcgtctgagcagcttacagcgtcgaatcttgaggcatatgagctggtgggtgagttagcgcttacaggcgcattacgcggcgttcctggcgcaatatcaagtgcaacggaagccatcagggccggcagaaatattatcgtcgcaacagagaacacggcggaggttgggcttatcagcaaagaaggatgttttatcgccgatcatctacaaaccgtctgcgcctttctggaagggaaacacgccctggaaagacctttagctcaggatatggcatcgtctaccgcaactgccgatcttcgcgatgtgatcggtcaggagcagggtaaacgcggcctggagattacagcggcagggggacataatctgctattgatcggcccgccgggtacgggtaaaaccatgctggccagtcgactgagcgggattcttccaccattaagcaatgaagaggcgttggaaagcgccgcgatcctcagtctggttaatgccgatacggtacaaaaacgatggcagcaacgtccctttcgctcacctcatcatagcacctcacttactgctatggtcggcggcggcgcaatacccgccccgggagagatatcgctggcgcacaacggaattttgttccttgatgaattgcctgaatttgaacgacgcacactggatgcgctacgtgaacctatagaatccggtcaaattcatttatcccgtaccagagcgaaaataacgtaccctgccaggttccagttaatcgccgcaatgaatcccagcccgaccggacattatcagggaaaccataatcgctgcacgccagaacagacactacgttaccttaatcggttgtcaggcccgtttcttgatcgttttgacctttcgcttgagataccgcttcctccgcccgggattcttagccaacacgcctcaaagggtgagagcagcgctacggtaaaaaagcgggtcatcgccgcccataaacggcagtaccgacgccagaagaagttaaacgcgcgtctggagggtcgcgaaatccaaaaatattgtgttttacatcacgatgacgcccgctggcttgaagacacgctggtgcatcttggattatccattcgcgcctggcagcgtttactaaaagttgccagaaccattgccgacatagaactggctgaccagatctcgcgtcagcatttgcaggaggcggtaagctatcgggcgatagacaggttgttaattcatttgcaaaagctgttggcgtaaaaaaagggcattacgccctttttattgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgccaaaataccgaagacaggcgttctacggagagaagcgtagagcggtaggcagcattttaaggaaactatgtgagtggaaaaatgtgaacattctggaagcggaatgctgtgcagatcatatccatatgcttctggagatcccgccgaagatgagcgtgtcagggtttatgggttatctgaagggaaaaagtagcctgatgctttatgagcagtttggcgatttgaaattcaaatacaggaacagggagttctggtgcagagggtactacgtcgatacggtgggtaagaacacggcgaagatacaggattacataaagcaccagcttgaagaggataaaatgggtgagcagttatcgatcccttatcctagcagtctgtttacgggccgtaagtaacgaagtttgatgcaaatgtcagatcgtatgcgcctgttagggcgcggctggtaagagagccttacaggcgcatcagaaaaacctccggctatgccggaggatatttattaatcatcagcttcggtgtagtcttctgcgccttcaacttgcggcttgccgccagacaaggtgtggaagcgttttggacgcttgatacgcgtcatatacttggaccagacgcgttctgcatccgttaccggctcgcgttcaccgcgacataccgctacaaacagcttctcttcttcagtcacaggctcacgcttgccaagatccagatcattaaaggcatgaccatgacgctcaagcagttgtgcctctttaatcgtgaaatcaccgtgacgagagaatccacgtggataatgtttattgtcaaaatatcgattagtcgtcgtaaagctttccgccatcctgcacgctcctaattctttgtctgagctatttatggcgcggagtattagttacgcttgacagagtgtaaaacaaaacatttaaatcataacgacaaataattttgtggagagcacagtggatacggaattgttaaaaactttcctggaagttagccggacacgccatttcgggcgggccgcagaagcactttacctgacgcaatccgcggtgagctttcgtatcaggcaactggagaatcaactgggcgtaaacctttttacgcggcacagaaacaatatccgtttaaccacggctggcgaaaaacttttaccgtatgcggaaacgctgatgaatacgtggtaggcggcacgtaaagaggtggcgcatacctcacgccataacgagttttccatcggcgccagcgcgtctttatgggagtgtatgcttaacgcctggctgggtcgactgtaccaactacaggagccgcaaagcggcctgcagttcgaagccagaatcgctcaacggcaatcgcttgtgaagcaacttcatgaacgccagcttgatctcctcattactaccgaagcgcccaaaatggatgagttcagcagtcagctgttagggcacttcactttggcgttatattgcagcagccctgcccgtaagaaatcagaactcaattatctgcggctggagtggggaccagacttccaacagcatgaaacagggctgatcgcagcagatgaagtaccggtattaacaaccagctcagccgaactcgcccgacagcagcttagcgcattaaatggctgtagctggcttcctgtaaactgggcaaatgaaaagggcggattacataccgttgccgacagcgcaacgctttcacggccgctatacgccatttggctgcaaaacagcgataaatactcgctgatctgcgatctgttaaaaacggatgtgctggatgaacaatgaaaatgatgaaaagaaaaagaagggaacttacgattacctgatcagataatcaggtaatttcaggcaaaaaaaaatccttagcagatgctaaggattatttctggcaggggcggagagactcgaactcccaacacccggttttggagaccggtgctctaccaattgaactacgcccctaattagggtggcggaacggacgggactcgaacccgcgaccccctgcgtgacaggcaggtattctaaccaactgaactaccgctccaccgaattcttttacaaccactgatttttacatcaatttactgcttaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaatatctcaaacgtgactcgtaagtcagttttgagatactgatggcaacgcctttcacacattaccgcgcaagtggcgtcccctaggggattcgaacccctgttaccgccgtgaaagggcggtgtcctgggcctctagacgaaggggacgtatcagtctgcttcgcaagacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgcccccccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcctctttcagagtcaaccctgaatttcaggatttttctcttcaaccgaccggctgtttgtgtgaagtgattcacatccgccgtgtcgatggaggcgcattatagggagttatctgctgaccgcaatagaaaaattgcagaaaaatgactgtttgctgcattccccagcaaaacccttggttatacccatttacgcacagacttatccacaaaatgcgcgttcatttcctcgatcttctcactctgcaaacgatctttcagggataaaagcggggccagaatttaaagagaaaaattcgcgagcgttgcgcaaacgttttcgttacaatgtcgccgcaaaatgagaatgccccataaggagcgttagctgagtttttcacgaaaaattcagctaacgctctctataatcgtcaaatccaggggatttaccatgcaacaacgtcgtccagtccgccgcgctttgctcagtgtttctgacaaggccggtatcatcgaattcgcccaggcactttccgcacgcggtgtggagctgctgtctacggggggcaccgcccgcctgttagcagaaaaaggcctgccggtgaccgaagtttccgattacaccggtttcccggaaatgatggatggacgcgtaaagaccctgcatccaaaagtacacggtggcatcctcggtcgtcgcggtcaggacgatgccattatggaacagcaccacatcgcccctatcgatatggttgtcgttaacctatatccgttcgccgaaaccgtggcacgcgaaggctgctcgctggcagatgcagtagagaacattgatatcggcggcccgaccatggtgcgctctgctgctaagaaccataaagacgtcgccatcgtggtgaagagcagcgactacgacgccattattaaagagatggatgctaacgaaggttctctgaccctcgacacccgtttcgatctcgcgattaaagccttcgaacacaccgccgcctacgacagcatgatcgccaactacttcggcagcatggttccggcctaccacggtgaaagcaaagaagccgccggtcgcttcccgcgtacgctgaacctgaacttcattaagaagcaggatatgcgctacggcgagaacagccaccagcaggctgccttctatatagaagagaatgtgaaagaagcatccgttgccaccgcacagcagattcagggcaaagcgctctcttataacaatatcgccgataccgatgcggcgctggaatgcgtgaaagagttcaacgagccagcctgcgtgatcgtcaagcacgccaacccgtgcggcgtggcggtaagtacctcgattctcgatgcttatgaccgtgcgtataaaacagacccgacctccgcgttcggcggcattatcgccttcaaccgcgagctggatgccgaaaccgcgcaggccatcatctcccgtcagttcgtggaagtgctcatcgccccatccgcaagcgaagaagcgctgaaaatcacctcagccaagcagaacgtccgtgttctgacctgcggccaatgggcaagccgcgttccgggcctggatttcaaacgcgttaacggcggtctgctggttcaggacagggatctgggtatggtgagcgaagctgaactgcgcgtggtgtccaaacgccagccgaccgagcaggaactgcgcgatgcgctgttctgctggaaggtagccaagttcgtgaaatccaacgccattgtgtatgccaaagagaacatgactatcggcataggcgcaggccagatgagccgcgtgtactccgcgaaaatcgctggcattaaagcggctgacgaaggtctggaagtgaaaggctctgctatggcttccgacgcgttcttcccgttccgtgatggcattgatgccgctgccgctgtcggcgtgagctgcgttatccagcctggcggttctatccgtgatgatgaagtcattgccgccgccgacgaacacggcattgcgatgatcttcaccgacatgcgccacttccgccattaattcagggagcagacgatgaaagttttagtcattggtaacggcgggcgcgaacatgcgctggcctggaaagccgcacagtcgccgctggttgataccgtttttgtcgcaccgggtaacgccggtaccgcgctggagcccgcgttgcagaacgtggctatcggcgtcaccgatattccggcgctgctgagctttgcccagaacgagaagattgatctgaccatcgtcggtccggaagcgccgctggtgatcggcgtggtcgatgcgttccgcgcggcgggtctgaagatctttggcccaaccgaaggagccgcgcaactggaaggctccaaagcgttcaccaaagatttcctcgcccgtcatcagattccgacggcggaataccagaatttcaccgagattgagcctgccttggcttatctgcgtgagaagggcgcgccgatcgtcatcaaggccgatggtctggctgcgggcaaaggcgtcatcgtggcgatgacgctggaagaagccgaagccgccgttcatgacatgctggcaggcaacgcctttggcgacgcgggccaccgtatcgtgattgaagagttcctcgacggcgaagaagcgagctttatcgtgatggtcgacggcgagcacgtgctgccgatggccaccagccaggatcacaaacgcgtaggcaacggcgataccggcccgaatactggcggcatgggtgcttactccccggcgccggtggtgactgatgaagtgcaccagcgcaccatggaacgcatcatctggccaaccgtgaaaggcatggcagcagaaggtaacacgtacaccggcttcctgtatgcgggtctgatgatcgacaagcagggcaacccgaaagttatcgagttcaactgccgcttcggcgatccggaaacccagccgatcatgctgcgcatgaaatcggatctggtggatctttgcctggccgcctgtgacggcaagctggatgagaaaacctccgagtgggacgaacgcgcttcattaggcgtggtgatcgccgcgggcggttatccgggcagctacagcaccggcgacgagatccacggtctgccgctggaagaagtggctgacggtaaggttttccacgcgggcaccaaactcgccgatgacgaccgcgtgttgaccagcggcggtcgcgtactgtgcgccaccgcgctgggccacaccgtggccgaagcgcagaaacgcgcttacgccctgatgaccgacatccgctgggacggcagcttcagccgtaacgacattggctggcgcgccattgagcgtgagcaaaactaacggctgagtttagccagcagcgttttgcgcgtaatgcccaattgacgggcggcttccgttttgttgccgcccgttttttccagcgccgccagaatcacctctttctccacatcgaccaacggttggatttcggcgctgttttccgcttttatcggcgtcgcggcaatagcgagaggcaattcgcgttcagaaatgtattctcccgtcagcaacaccaccgctcgttcgatagcgttttccagctcacggatattacccggccagtcgtagtggatcagcagatccatcgcctgcggcgtaaaccccttcaccgcttttcggttacgttcggcaaaacgccgcagaaaatggtctgccagtagcggaatatcttcccgacgctggcgcaaagaaggcatttcaatcgccaccacattcaggcggtaatagagatcctggcgaaagcgaccggcactcacctcttccgccaggtcgcggtgggtagcggcaattaaccaaacatccacagatatcgtctggttacttcccacgcgttgcacttcgcgctcctgaatcgcccgcagcaaacgtacctgcattaacggcgagatatcgccgatttcatcaagaaacaatgtcccgccgtcagcttcgacaaagcgtccctcccgacgtttatccgcgccggtaaacgcgcctttttcgtgtccgaacagctcagactccagcagcgattcattaagcgccgcgcagttgagcgtgaccagcggtttatcgctcctggcgctacaggcgtgcagcgcccgcgccaccagctctttacccgtgccggagtctccgtgaatcaataccgtggcgtctgatggtgcgaccatcgcgatttcattcaataaatgttgcatcgccgggctgctgccaatcatgccaaattgcgcagccgacgccgatggcaattcagcgcccgtttcccgcgtatgcgccaacgccttttccagcgtctcctgcagacggtcaaaatccagcggtttaattaaatagtcgagcgcgccggctttcaacgcctctaccgccgtttccacgctggagaatgccgtcataatcaaaatcggaatggcggggttgagcgctttaatctccttcagcgtggcgataccgtccatctccgccatacgcacatcgcacagtaccagatcaaagactttctcacgcacctgagccaacgcatcatgcccactgtaggccagagcgacgttatagccccagccccgaagcagcgcctgtaaaatcgtgcagtggcttacatcatcatccacaaccagaatatcgatttttccgcgtatcacccttgttaattctgttgtctcgctatcactggcaaccagatagtaaagaccgcgcctttaccctcaatacttttcaccttaatcgcgccgccatgctgttcgatgatattttgcaccaccgccagccccaggcctgtcccgtcagctttggtcgtaaaataaggtgtaaaaatcgcctccagctgatccggggcaatccctttcccgctatcggtaacagtgatgataacgcggtcggtcccactttcttttgcctctacggtaatcgttccctggcggccaatcgcatgaatagcgttcaggtacaaattcaacagcacctgagtcagcctgtccgggtcagcctgaatacgcttaagcgtctcattcgccgtgaatctcaactgaatctctctgctttgggcatcctgactgaccagattcagggagtgagtaataatatcattgaggttaaccgcctggagcgtcagatgcgcgggctttaccagttcgagcaattcgcttaccacccggttcaaacggtcggcctctttggccatcacctgcgccagttcatgcgactcgccgccggcaggcgtgcgctcggcaaagtatttcgccagccctttgatggacgagagcgggttacgaatttcgtgcgcgacgcccgccgccagatgccccatcgccaccaacttttctttacgcttcattgcatcaagcagttctctgtgcgagcgctgataacgctgataccaaaaaaacgccagtaacgttgccaacagcaccgccgctaacgcagacaaaacaatcagcgtattacgccactcccttgcctgagtcgcggccagctcgctggcgtcaaaggcaataaaaatagtttgtttcgctggttcgtcgtcattggcgctacgcgccatgccgtgccccctcatactgtgacctctcataccgaaaagcggctggaactgacggtaaatttccagcgcaggcaccgtctcgccgttagcagcaacgtcgacacgccgccaacactcctgcggcccggggtttagttgatgcatttcagatggggaatagagcgacttgcccaccatgccagggttgctatgagtgatgattaccccctgtgcatccgttacagcgaatcacaacacgcctggctgacccgccatctcttccagcaatgtctgctgctgcgcgtgatgcatccgcattcccatacctactcgcgtgccggactccagagcgcgaatgagtacatttcccttttccagcagcgtctgcctggcggcagcgctctcacggccatagtcgcgaatgaccataatggaaaatagccccaccagaatgaagatcgccgcaggtaacagccgactcaaccacattgcagcggcatctttatgtaatcgtataaaactcacaggcttccccggctcgtttttattttccttacttaagcagagatcatgccattcttcgctccgcataaccgcgcgttgtcgcacaccctttcggatacggatgggtaaaaatgactcgccaggcgggtcatgcgagtcatttttactcgctttttgccgcctgaagcgggttaactcgctgcccgacaaggaatagttacctggcacggaagatgcaagagagaggataagatgagcaacaggagaacgcaaaatgaaacggaacaataaatcagctatcgcgctaatcgccctctctcttttggccctgagctccggcgccgccttcgccgggcatcactggggcaacaatgacggtatgtggcaacagggaggtagcccgttaaccacggaacagcaggcgacggcgcagaagatttatgatgattactatacgcagaccagcgcgctgcgccagcaactgatatccaaacgttatgaatacaacgcgctactgatcgccagttcgccggatactgcgaaaattaacgcggttgccaaagagatggagtcattaggccagaagttagatgagcaacgcgtgaaacgggatgtcgcgatggcgcaggctggcataccacgcggcgcaggaatgggctatggcggttgcggcggctatggcggcggttatcatcgcggcggcggtcatatgggtatgggaaactggtaaagcatgtttgccgaatggcggcttcgccattcggtattccatcaaaaggttttcgcttgcggctgccagtgacagaaatctgaattcgccaccagcaaaagttgcgatccttccggcgcctccagccatgctacgctcacctctaccgatgagtggttctggcggcgctcaatgtggcttattgtccaagaatccagatccggtttcagcgtttcaccttcacaggtggttatcgtatggtcggcgtgccagcgtccctggcgtagtatgacccgccccaggcgcaatgcgtcgctggtctgacggatttgttcggcacgatagcgatacaaggcaatctgatcgttggaaagctgctgcttctgccccccgatttcacgctgcataaaactgagttcgccatgagcgtcgaaacgcgcgcgaatatgttctggcggtttgctgtaaatattgagttcaataagcgaaagcgtatcaccctgccaacgatattcgctggtcgtcgtgctaccactatgccacgggctaaaaacagaaagcagatggacttcatcgttcgtatctttacgccagatacgcaccgcgccgtgatcgccggcaaagccgctggcagtaaacggaggcggtgaagcgttatgactgcaggcagtcagcaacagcgcgccagaaaacagaaacgcgtgacgccagacggacaaaaggggctgacaagccccttcgataaaactgttcacagttacgcgtcttacttaactgcgtctttcagagctttaccagaaacaaacgccggtacgttagcggcggcgattttgatttctttaccggtctgtgggttacggccagtgcgctcagcacggtggttcactttgaaggtaccgaaaccaaccagttgtacagcatcgccttctttcagagactcagtaatagcagccagagtggattccagagcagctttagcctgggttttggacagttctgctttgtctgcaattacatcaatcagttgagtcttgttcataagttatccttacaatgtgtttatcgcttgctaagcatcgagtgcgacggaaatgccagaaaagcactctcctgcatacacgcaccgatagccactttttttcgcctcccaaatgtagaccagacggggggcataagggaagccttatggcacgacaaatcagacgttaaatcacgttttctggtgtcattgctgaaaatttataccgatattgctctcgccagcctcgcgcaggtctgccctgagcccttttatcagttcaatatcacgttcttcgcagtcggctaaaagtcggaatatttcccactgaatatcccattcctgttcaacggcagggttcgttttgagctcctcatcggtcatttcccgaccagcctgagtcatttccaacatcgctaccgtagtaatggaagtcttactaacctcaatagcatgttccagcgtttcgccgctaagacgagaatgcattaattcgcttaatgcgacgcaggcatcaatcgccgggtaaacgccgtacaaatcatagtcgtcggctgccggaattgcctcttcaaacttctccagttggctatcgaaattgacctttgcatctttcaccgtcagggtttcccagatcagatccagaatgcgacggtagatctgtccgtcgccgaattccgtctgcttgcaaaacatggcgtagttcgggtacatgcgctcgcacaagcaggccataaaggtaacgtgctgccaactttccagccgctccagccgcaaatgaatcgggttttgtaacatgatggaatctcgaatcggaaattagcggcagtttacctgaatcagcgctgaatttcttgccaacgaacaaacgccggacgcccggaagcgacggcatccgcccagcgcgtcggctccggcaggcgataccctttcatacagcgctgtacccacgccagcgcgctgtcagtactgacccggtgccctgtcgcgataaacagcggattacagcgcgccttgctgcgccatacccacgccagttgctcgcctttatccattaaggggctaagtgcgccaggttcggcggaaagtggttcaaatttaccgcatagccgttttttcgccacgccgatggtcggcacgtccaccaacagtccaaaatgactggcgacgccaagccgacgcggatgcgaaataccgtgaccgtccacaaacagcaaatcgggcttttgcgagagctgttcccacgctgccagcagcgcaggatattcacgaaaagagagaaagccggggatatacggcatggtggtggcaatacgcgccaccttgtactctactagctcaagcgacggatatttcagcaataccatcgccgcccgcgtcacctcgccgccctgctcaaaaccgacgtccgccccgccgataaacgctggcggatctttgtccaggcgatcttcgcggcaaactgatgaagcaagttctatctgttgagcgcgtagcgacgcgagatccatactaactccttagttgtgatactgcgcagaaagtcggtgcactgcctccacaaatgcgccagcatgttctggcggcacatcctgatggatgccatgtccaaggttaaagacgtgcccttctccctgaccgaaaccagcaagtatagtcgctacctcgtcttcgatccgtgccggcggcgcatacagcatggacggatccatattgccctgcagcgccactttatggccaacgcgacggcgcgcatcggcgatatctgtcgtccagtcgagacccagcgcatcgcagccggtttccgccatcgcctccagccactgaccgccacctttagtgaacagcgttaccggcacgcggcgaccgtcgttttcacgcagcaggccatcgacgattttatgcatgtagtagagggagaactgctggtaatcgcggccagtcagcacgccgccccaggtgtcgaaaatcatcaccgactgcgcgcccgctttgatttgcgcgttgaggtacagcgtgacgcttttcgccaacttatccagcagcagatgcaacgcctgcgggtcagcgtacatcatctttttaatcaccgtgaaggctttgctactgccgccttccaccatgtaagtcgccagcgtccacgggctgccggagaagccgatcagcggaacctcgccttttagttcgcggcgaatcgtgcgtaccgcattcatcacgtagcccagttcatcctccggatcgggaatgggcagcttatcgacatcggctttgcaggtgacaggggccgtaaagcgcgggccttccccggcttcaaaatagagccccaggcccatcgcgtccggaatcgtcaggatatccgagaaaaggatcgccgcatcaagcggataacggcgcagcggctgtaaagtgacttcgcaggccagttcggcatttttgcacagcgacataaaatcgcccgcctgagcgcgagtggctttgtactccggtagataacggcccgcctggcgcatcatccacactggcgtaacatcaacgggctggcgcagcagcgcacgtagataacgatcgtttttgagttcggtcatttttacattcctttagcgttgatgcgcccagtgtaacatgtcagtcgtattcagcccgacacattgccaccgtatcttcgatcaaacggcgcgcgacggtgcccggcggcggcagtagcggcagatcgtcataacggtaccaatttgcttccaacagttctttcgggtcgatgacaatctcgccgctgtcatactctgccataaacgccgtcatcagcgactgtgggaacggccacggctgcgaggtcacgtagcgcagatttttcaccttgatcccgctttcctccatgacttcgcgcgccacagcctgctccagggtttcgccgacttcaacaaacccggccagtaccgtatgcacgccgttgcggtggcgaacgtgccgggcaagtagaatagaatcctcacggcgaatggcaacaataatgcagggggcgatttgcgggtagtaacgatcgcggcaatggctgcacagcatcgcccattcggttttactcgggtgcatagggtgcccgcaatagccgcaaaatttatgcgaacgataaaactccgccaactgtacgccacgtcccgccagttgaaacagcccggcatcctgatcgataacctggcgaaccgatcccatatcatgacgtcgatgctgtaacaccagccagacgggctcgccttgccattcacctatccggagtgcgcgctgccccacaagatcgaaatttgccgccagcccgtgtggtaattccccatacggcaaccataatttttgttcatggctgacgatccaccagccactctctaatttttcaattatacgatccatagctattgcactacctttgcttcactggcatgttgttaacattatttttacattcatggcgagcagcctttatctaacttgcggagacaatcatgctaaaccagctggaaaacctgatggagcgcgttggcggaagcaacaaactggtcgatcgctggctggatgtacgtaagcacctgctcgtggcttactacaatctggttggcattaagcctggcaaagaatcgtacatgcggctgaatgaaaaagcgctggatgatttttgtcagagcctggtcgattacctttccgccgggcacttcagtatttatgaacgtattctccataaattggaaggaaacggtcagcttttacatgcggcaaaaatttggccgctgctggaagataatacgcagcgcattatggattattacgacaccagcctggaaactgccatcgatcacgataattgtctcgaatttcaacaagctctgtcagatatcggcgaagcgctggaagcccgctttgtgctggaagacaagctgattatgctggtgtttgacgcgatgcacgacggcgccagagtcaaacgtcccgcttgagttctgcgcgagtaacaggtagtttacttcagccccctcttcggaggggcggttatcttgtcggagtgctaattttccacaaaagcgttcgtgatgcgtcaaggcggcaagtcggtgaatctccaggagcttacataagtaagtgactggagtgagcggacgaagccaacgaagaggcagcgcgaaggatgaagtggaaaaggctgagaccgttaattcgggatccgcggaacctgatcaggttaatacctgcgaagggaacaagagtaattctgctttatgctgctgcctttacgggcggcgcacatccattactccatccgtcgtctgacaagccacgtccttaattttttggaatgagctatgtctacaacaacgttaacccgccgcgagcagcgcgctaaagcccagcattttatcgatacgctggaagggactgcctttcccaactcgaaacgcatctacgtgaccggttcgcagcatgatattcgcgtaccgatgcgcgaaattcaacttagccctacgctcatcggcggcagtaaagacaacccgcagtttgaagagaacgaagccgtaccggtatacgacacctccggcccctatggcgatcctgaagtggcgattaacgtccagcagggtctggcgaaactgcgccagccgtggattgacgcacgtaacgatagcgaagaattagacgaccgtagctcggcttacaccagagaacgtctggccgacgatggcctggacgatctgcgttttaccggcctgctgacgccgaaacgcgctaaagcgggcaagcgcgtcacccagttacactacgcccgccaggggatcgtcactcccgaaatggagttcatcgccatccgtgaaaacatgggccgcgagcgcattcgcagtgaagtgctgcgccaccagcatccgggcatgaactttggcgcgcgcctgccggaaaacattacgccggaattcgtgcgtgatgaagtcgccgcgggccgcgcgattattcccgccaacatcaaccacccggaatcggagccgatgattatcggccgcaacttcctggtcaaagtgaatgccaacatcggtaactcggcggtcacctcctccatcgaagaagaggtcgagaagctggtgtggtcaacccgctggggcgcggacacggtgatggacctctccaccggtcgctatattcacgaaacccgcgaatggatcctgcgtaacagcccggtaccgatcggcaccgtcccgatctaccaggcgctggaaaaggtcaacgggatcgccgaagatctcacctgggaagcgttccgcgacacgctgctggagcaggccgaacagggcgtcgactacttcaccatccacgccggcgtgctgctgcgctacgtgccgatgaccgccaaacgcctgaccggtattgtctcgcgcggcggttcgatcatggcaaagtggtgtctctcccatcacaaagagaacttcctgttcgaacatttccgcgagatttgtgaaatctgctccgcctacgacgtttccctgtcgctgggcgacggcctgcgccccggctccattcaggacgccaacgacgaagcgcagttctccgagctgcatacgctgggcgagctgaccaatatcgcctgggaatacgacgtgcaggtgatgattgaaggcccgggccacgtgccgatgcatatgattcagcgcaacatgaccgaagagctggagagctgccacgaagcgccgttctacaccttagggccgttgaccaccgatatcgcgccgggctatgaccacttcacctctggcattggcgcggcgatgatcggctggtttggctgcgcgatgctgtgttacgtgacgccgaaagagcatctcggcctgccgaacaaagaagatgtgaagcaggggctgatcacctacaaaatcgccgcccacgccgcggatttagccaaaggacatccgggcgcgcagatccgcgataacgccatgtcgaaagcgcgctttgaattccgctgggaagatcagtttaacctcgcgctcgacccgttcaccgcccgcgcttatcacgatgaaaccctgccgcaggagtccggtaaggtcgcccacttctgttccatgtgtgggccgaagttctgctcaatgaaaatcagccaggaagtgcgtgattacgccgccgcgcaagccattgaagtcggcatggcggatatgtcggagaacttccgcgccaaaggcggcgaaatttatctcaaacgggaggaagcctgatgtatcagcctgatttcccaaccgtgccgttccgcctcgggctttacccggtggtggacagcgttgcatggattgaacgcctgctggaggcgggcgtgcgcaccatccagttgcgtatcaaagataagcgcgatgaagaggtggaagccgacgttatcgccgccatcgcgctggggcgttgttatgacgcccgcctgttcatcaatgattactggcgtctggcaattaagcacaacgcctacggtgtacatttgggccaggaagatctcgaaaccactgacctgaaggcgattcaggcggcggggttacgcctgggcgtatcgacccacgatgatatggagatagacatcgcactcgccgctaagccttcttatatcgcgctgggtcatgtattccccacgcaaaccaagcagatgccttccgccccacaggggctggcgcagctggcgcggcatattgaacgactggcggattatcccaccgtcgctatcggcggcatcagccttgaacgcgctccggcggtactagcgaccggcgtcggcagtattgccgtggtcagcgccattactcaggctgccgactggcgcgccgctaccgcgcagttactggcaatcgcgggagtgggcgatgaatgaccgcgattttatgcgctacagtcggcaaatcctgctcggcgatatcgcgattgaaggccagcaaaagctgctcaatagccatgtattgattgtcggcttaggcggattgggttcgcctgccgcgctgtatctggcgggagcaggcatcggcacactgacgctggcggatgatgacgatgttcacttgagcaatctccagcggcaaattctgttcaccaccgacgatatcgcgcgttcgaaatcccaggttgcccagcagcacctgacacggctcaacccggatatcgaactggtatcactccagcagcgactaaaaggcgatgcgctccggcatgcggtagcgcgtgccgacgtggtgctcgactgtaccgacaacatggcgacccgtcaggaaattaacgccgcctgcgtggcactcaacactccgttaattaccgccagcgccgttggttttggcggccaagtgatggtcctcacgccgccgtgggaacaaggctgttaccgctgcctgtggccagatgatgtggagcctgaacgcaactgccgtaccgccggtatcgtcggaccggttgttggcgtgatgggcaccttacaggcgctggaagcgattaaattactcagcggtattgagacgcccagtggagagctacgcctgtttgacggtaaaaccagccagtggcgcagcctggcgctgcgtcgtgccagcggctgtccggtatgcggagggcgacatgcaaattcaattcaatgacgagccgatgcagtgcgccgaagggcaaaccgtcagcagcctactcgctacgcttaatcagcttcaaccgggcgcggcgctggcgctcaatcagcagatcctgccacgcgagcagtggcggcaacatatcgtgcaggaaggcgaccagattctgctttttcaggttattgcaggaggttgagatgttacgtattgccgacaaaacgtttgattcacatctgttcaccggtaccgggaagtttgcctcatcgcaactgatggtcgaggcaattcgcgcttccggcagccaactggtgacgctggcgatgaagcgcgtggacctgcgccagcacaatgatgcgattctggcgccgctgattgaagcgggcgtcacgctgctgcccaatacctccggggcgaaaaccgccgaagaggcgatcttcgctgcccagctggcgctcgaagcgctgggcacccactggctgaaattagaaatccacccggacgcccgttggctgctgccggatccaatcgaaacgctgaaagccgccgaggcgctggtgaagcaaggttttgtggtgctgccctactgcggcgcggatccggtgttgtgcaagcggctggaagaggtcggctgcgcggcggtgatgccgcttggcgcgcctatcggttcgaatcaggggctggaaaccaaagcgatgctggagattattatccaacaggcgaccgtgccggtggtggttgatgcgggcattggcgtgcccagccatgccgcgcaggcgctggaaatgggcgctgatgcggtgctggtcaacacggcgattgccgtggcggacgatccggtgatgatggcaaccgctttccgtctggcggtggaagccggattactggcgcgtcaggcggtgccgggtaatcgtagcacctacgccagcgctaccagcccgctcaccggatttctggaggcgttagcatgaaagccttcaccgaccgttggcggcaactggagtgggacgatattcgcctgcgcatcaacggtaaaaccgccgccgatgtggagcggacgctgaatgcttcacgcctcaaccgcgaggatatgatggcgttgctctcccccgccgccgccgattatctggaaccgatggcgcagcgggcacaaaggctgacccgacaacgctttggcaacaccgtcagtttctacgtgccgctctatctctcaaacctctgtgccaacgactgcacctactgcggcttctctatgagcaaccgcatcaagcgtaagacgctggatgaggtggatattcaaagggagtgcgatgctatccgtaaactgggttttgagcatctgctgttagtcaccggcgagcatcaggccaaagtcggcatggactattttcgccgtcatttacccaccatccgccgtcaattttcctctttacagatggaagtccagcccttgtcgcaagaaaactacgcggagctcaaaacgctggggatcgatggcgtgatggtttatcaggaaacttaccatgaggcaatctatgcacagcatcacctgaagggaaagaaacaggactttttctggcggctggaaacgccggatcggttaggccgggcaggtatcgacaaaatcggtcttggcgcgctaattggtctgtcggacaactggcgggtggattgctatatggtggcggagcatctgttgtggatgcagaaacactattggcagagtcgctattctgtttccttcccgcgtctgcgtccgtgtaccggcggtgtggaacccgcatctgtgatggatgaaaagcaactggtgcaaacgatttgcgcgtttcgtttactggcgccagaaattgaattatcactctccacccgcgaatcgccgtggtttcgagaccatgtgattcctctggcaatcaacaacgtcagcgccttctcgaaaacccagcccggtggctacgctgacgatcatccggaactggagcagttttctccccacgatgaccgtcggccagaagtcgttgcaagcgcgttaagcgcgcaagggttacagcccgtatggaaagactgggacagttggctggggcgcgcttcgcaaatgcggtgaacccgtatgtaaacgcattaatatttcacgagcgagtacgtaatgtgaaaaacgggagattgttatcggcctcccgttttttattttgtcatcgtcagcaacggaagctgaccagggcaaattatcccttcctcatttttgcccaaccttctccccttcatcagtaactgacgaccaggggctggccactggattatcgaaatagcggtgaacttgaagttttcgggcagcgttcctgactgtaatttcgctggcggcccctcttccaaccgtgtctgctgatcgtttttgtccataaaatgatgccccagaacaacgggaatcaggggcgaacccatcagggaaaaatgtgttgcggccggacgccgatagtaacgttacttgatggaaaacgcatctgggctgagaaaaatttaagccagatgtaatctgacagatatctgtataaataaccggtaactgtcagatcaggtctgagataatacatatcattttacctatacgcactacatcctcggacatctgggattggtgcattatccgattataaagtcgtctgtgtgttttttcggcctaaagaccttaatggaattgaatccttcatttaatgatttaaaatgtcccgcgtaaacaatcaataaaacaggtttatcatttaatgtatgaacagcaggcattttataatggcgagccaatagactttaataacttagatttatgggataaatttaaagtcacatttggactaaatgttacagaaaaaaccaaacccaatggtaaaaaatttcaattttgagtattgtggattctctacttttattacgccggttgatggcgttggcgggattttagcaaagtggctctcaaacaaacataatgtaagtgtcccaacgccttatacattcggtcaggaccccattcctggcatcaatctttatcgtaatacaaaagcaaaatttgttatggctaacggtggtaatagtcttccctgtgcgatatcaaaatataatgcaaaaactggacagtttattcatataaccagtgataatgatttttcaccaataatacgagaaacaagagtcatgaaaaaataattcatttattcattaatatttataattacagataaaaccaagagccagcatggcattgaaaaataaaatacggcttttttatccgcgctggttttgactcgatgaagaatagcggtggcgacaataataataagacaataaataaatataagtaatgatttatggtgaagtatatataacgatagaaacaataaaaaagcggacagaacgtttgaaatggttatcttttttgtaaatactaaaagactaaacattaaatagattaatgaaataatcgctggcattttctttccttgtaggcaagcgacccggaattcggtatccagcatgaagctggtggagggataaatacccctccaccatttaacgattactcgttatcagaaccgcccagacctgcgttcagcagctctgccaggcttgcagatgcatcttccgcagtgacctgcggtgttgctggctgctcgcccgcggcgcgacggcgcatacgatcctggtgatacgcataaccggtaccggccggaatcagacgacccacgataacgttctctttcaggccgcgcagttcgtcgcgtttacccgcaacggctgcttcggtcaggacacgcgtggtctcctggaacgatgcggcagagatgaacgactcggttgccagagacgctttggtaatacccagcagatcgcggaagaaggtagcccccactttgccgttcgcttccagctcgcggttagcgatcttgacgcgagagtattcaacctgttcgccttccaggaagtcggaactaccggcgctttcgatggtcgctttacgcagcatctgacgaacgataacttcgatgtgtttatcgttaatcttaacgccctgcagacggtatacatcctgaacttcgttaacaatataacgcgtcacagcatgaacgccacgcagacgcagaatgtcgtgcggcgcttccggaccatcggaaatcacatcaccacgttctacacgttccccttcgaacacgttgagctgacgccatttcggaatcatctcttcgtacgggtcactaccatcaaccggcgtaatcactaggcgacgtttgcctttggtttctttaccgaaggaaacgatacctgcgatttccgccagaatggccggctctttcggacgacgcgcttcgaacagatcggcaacgcgcggcagaccaccggtgatatccttggtaccgccggattcctgcggaatacgcgccagggtgtcaccagaactgatctgtacgccatcttccagctgtacaatcgctttacccggcaggaagtactgcgcaggcatatcggtacccgggatcagaacgtcattaccctgagcatcaacgattttcagcgccggacgcagatctttaccaccggtagtacgttcagccgaatccagaaccaccagcgaagacaaaccggtcagttcgtcggtctgacgcgtaatggtctgaccgtcgatcatgtcagtgaagcggatgaaaccactcacttcggtgataaccggcatggtgtgcgggtcccagtttgccacggtttcgccgccggcaacctgctcgccatcacctttcgccatgactgcgccataaggcactttatagctctctttggtacgaccgaattcgtcgatcagcttcagttcggtgttacgggaagtgataaccagtttaccgctggagttcacaaccgacttcacgttgctgagcttgatgctacctttgttcttaacctggatgctggattcagcagccgcacgcgatgccgcaccaccgatgtggaacgtacgcatcgtcagctgtgtacccggttcaccgatggactgtgccgcgataacgccgatagcttcacctttgttgatgatgtggccacgcgccaggtcacgaccatagcagtgcgcacatacaccaaaatcggtatcgcaggatacaacggaacgcactttaacggcgtcaacggagtttgcttccagcaggtcacaccactgttcgtgcagcagcgtgttgcgtggaaccagaatgtccgccgtacccggcttcagcacatcttccgccgtcacacgacccagaacgcggtcacgcagcggctctttcacgtcgccaccctcgataaccggggtcatcaggataccttcgtgcgtaccacagtcatcttcggtcaccaccagatcctgcgcgacgtcaaccagacgacgggtcagataaccggagttcgcggttttcagtgcggtatccgccagacctttacgcgcaccgtgcgtggagatgaagtactggagtacgttcagaccttcacggaagttcgcggtgattggcgtttcgatgatggagccatctggcttcgccatcagaccacgcatacctgccagctgacgaatctgtgccgcagaaccacgcgcaccggagtcggccatcatgtagatgctgttgaaggaaacctgctgctcttcctggccgtcacggttaatcacggtttcggtttgcaggttatccatcatcgctttggatacacgatcgttcgccgcagcccagatatcgataactttgttatagcgttcgccagcggttaccagaccagactggaactgctcctggatctcagcaacttcggcttccgcttcagagatgatctcgtgttttttctccgggatgaccatgtcatcaataccaacggacgcacctgaacgcgctgcataagcaaagccggtgtacatcgtctggtccgcaaaaataacggtcggtttcaggcccagaatacggtagcaagtgttcagcattttggagatcgctttcttgcccagcgcctggttgacgatggagaaaggcagacctttcggtacgatcatccacagaatggcgcgaccaacggtcgtgtctttcaggctggtgtgcgcaacgaattcgccgttttcatctttttcatattcagtgatacgcactttaacgcgcgcatgcagagaggccagacctgcgcgatagatacgctcagcttctttcgggccagtcagcaccatgccttcgcctttggcgttaacacagtcacgggtcatgtagtacaaacccaataccacgtcctgagacggaacgatgataggttcgccgttcgccggagacaggatgttgttggtagacatcatcagcgcacgcgcttcgagctgggcttccagcgtcagcggtacgtgaacagccatctggtcaccatcgaagtcggcgttatatgccgcacaaaccagcgggtgcagctggatagctttaccttcgatcagtaccggttcaaatgcctggatacccaaacggtgcagtgttggtgcacggttcagcagtaccgggtgttcgcggatcacttcgtccaggatatcccaaacgacagcttcttcgcgctcaaccattttcttcgcggctttgatagtggtggcgagtcctcgcagttccagtttgccgtagatgaacggtttgaacagctccagcgccattttcttcggcagaccgcactgatgcagacgcaggtatggacctacggtgattacagaacgaccggagtagtcaacacgcttaccgagcaggttctgacggaaacgaccctgcttacctttgatcatgtcggccaaagatttcagaggacgtttgttagaaccggtgatcgcacgaccgcgacgaccgttatccagcagggcgtcgaccgcttcctgcagcatacgtttttcgttgcgtacgatgatgtccggcgcagccagatccagcagacgtttcagacggttgttacggttgatcacgcgacgatacagatcgttcagatctgacgtggcgaaacgaccaccatccagcggaaccagcggacgcagatctggcggcagaaccggcagaacggtcaggatcatccactctggcttgttgccagactgtacgaaggcttccagcagtttgatacgcttggtcagctttttacgcttagtttcggagttggtttcgttcagctcttcgcgcagagtttcacactcttgctccagatccatgctcttcagcagggcctggatagcttccgcacccatcttcgcgtcgaattcgtcaccgaactcttccagcgcgtccagatactgctcttcagtcaggatctgttgacgttccaggttggtcataccgccttcgataaccacataagattcgaagtacagtacgcgttcgatatcacgcaacggcatatcgagcagcagaccgatacgggacggcagcgatttcaggaaccagatgtgagcagtcggagacgccagctcgatgtggcccatacgctcacggcgtactttggtctgggtcacttcaacgccgcacttctcacaaataacaccacggtgtttcaggcgcttgtacttaccgcacaggcactcgtagtcttttaccggcccaaagatacgggcgcagaaaaggccgtcacgctcaggtttgaacgtacggtagttgatggtttccggctttttaacttcaccgaaagaccatgaacggatcatgtctggcgaagccagagcaattttgatcgcatcaaactcttcggttttagtctgcgctttcagaaactttaataaatctttcacggatttgctcccgtcggagttagcacaatctggtgtcgggttttaccccgacaccagtgacctgtttgagcgagaattactcgtcttccagttcgatgttgatgcccagcgagcggatctctttcaacagaacgttgaaggattccggcatacccggttccatctgatggttgccgtccacgatgttcttatacatcttggtacgaccgttcacgtcatcagacttaacggtgagcatttcctgcagggtgtaggcggcgccgtaagcttccagcgcccacacttccatctccccgaagcgctgaccaccgaactgcgccttaccacccagcggctgctgagtaaccaggctgtaagaaccggtagaacgcgcatgcatcttgtcatcaaccaggtggttcagtttcagcatgtacatgtaaccgacggttaccggacgttcgaactgttcacccgtacggccatcgaacaaggtgatctgaccggaggtcggcaggtcgcccagtttcagcagctctttgatttccgcttctttcgcaccgtcgaacactggtgtggcaatcggcatacctttgcgcaggttttctgccagacgcagcacttcatcatcgctgaaggtgctcaggtcgactttctgacgaacgtcggcgcccagatcgtaggcacgctggatgaattcgcgcagtttcgcgacttcctgctgctgtttcagcatggcgttaatcttgtcgccaatacctttcgcagccatacccaggtgggtttccagaatctgaccgatgttcatacgagacggtacgcccagcgggttcagtacgatgtctaccggcgtgccgttttcatcgtaaggcatgtcttcgatcgggttgatcttagagataacacccttgttaccgtgacgacctgccatcttatcacccggctggatacggcgtttaacggccagatagaccttcacgatcttcagcacgcccggcgccagatcgtcgccctgggtgattttacggcgcttcgcttcaagttttttctcgaactcgtgtttcagttcgtcatactgctcagccagttgttccagctgattttgtttctcttcgtcggtcagaccgagttccagccagcggtcgcgcggcagtttgtcgagcttctcagcttcaacgccgccggacaccaacaccgcacggatacggctaaacaggcccgcttcgaggatctgcagttcttcagacaggtcttttttcgcctgcttgagctgcatctcttcgatttccagagcacgtttgtctttttctacgccatcgcgagtaaagacctgaacgtcgataaccgtaccggagacaccgttaggtacgcgcagagaagagtctttaacgtcagacgctttctcaccgaagatcgcacgcagcagtttctcttccggcgtcagctgggtttcacctttcggcgttaccttaccgaccagaatgtcgccgccagtcacttccgcgccgatgtaaacgataccggattcatccagtttggagagcgcagcttcacccacgttcgggatgtcagcggtgatctcttccggccccagcttggtgtcacgggacacgcacgccagttcctgaatgtggatggtggtgaaacggtcttcctggacaacacgctcggaaacgaggatggagtcttcgaagttgtagccgttccacggcatgaacgccacgcgcatgttctgaccgagcgccagttcaccgaggtcggtggacggaccgtctgccagcacgtcgccgcgttcaaccggctcgcccagagacacacatggcatctggttgatacaggtgttctggttagagcgggtgtatttggtcaggttatagatgtcgatacctgcttcacccgggtacatctcgtcttcgttaactttgataacgatacgggatgcatccacgtactgaacagtaccgccacgtttagctactgcagtaacaccggagtcgacggcgacagcacgttccataccggtacccaccagcggcttatcagcacgcagagtcggaaccgcctgacgttgcatgttcgcacccatcaatgcacggttggcgtcatcgtgttccaggaacgggatcagggacgcaccgacggagaccacctgctgggtggaaacgtccatgtagtcaacctggtcgcggctgaacaagctggattcgcctttgctacggcaggttaccagatcttctacaaagtggccttcgtcatccaggttggagttcgcctgagcgataacgtagttgccttcttcgatagcagacaggtaatgaatttcgtcagtaaccacgccatcaaccacacgacggtacggcgtctcaaggaagccatattcgttagtctgtgcgtacacggacagggagttgatcagaccgatgttcggaccttccggcgtttcgataggacatacgcgaccgtagtgcgtcgggtgtacgtctcgaacttcgaagcctgcgcgttcgcgggtcagaccgcctgggccgagtgcggagatacgacgtttgtgcgtaatctcagacagcgggttgttctggtccataaactgagacagctggctggaaccaaagaactctttcactgcggcggaaatcggcttggcgttgatcatatcctgaggcatcagggtatccagatcgcccagagacagacgctctttcaccgcacgctctacacgcaccaggccaacgcggaactggttttccgccatttcgccgacggaacggatacgacggttgccgaggtggtcgatatcatccacttcgcctttaccgttacggatatcgatgagcttcttcatgacatcaatgatgtcgtctttgctcaggataccggaaccttcgatttcgtcgcgcagcagagaacggttgaacttcatacgacccaccgcagacaggtcatagcggtcttcggagaagaacaggttctcaaacaggctttcagccgcttcgcgtgtcggcggctcaccagggcgcatcatgcggtagatttctaccagcgcgctcagacgatcgttagttggatcgacgcgtaccgtttcagaaatgtacgggccgtggtccagatcgttggtaaacagcgtttcgatacgcttgtggccggactggctcagcttagccagcagatccaggctcagctccatgttcgccgcgcagatcagctcgccagtagattcgtcaacgtagtctttagagacgactttacctgcgatgtactcaaccggaacttcgatatgcttgatatcgtctttttccagctgacggatatgacgcgcggtaatgcgacggcctttttcaacgtacaccttgccgttagcttcgatatcgaacgacgcggtttcgccgcgcagacgttctggaatcagctccatctgcagcttgttgtcgcgaatttcgaagacgactttctcaaagaacaggtcaaggatctgctcagtggtgtagttcagcgcacgcaggatgatggtcgcaggcagtttacggcgacggtcgatacgcacgaacaggttgtccttcggatcgaattcgaagtccagccaggaaccacggtaaggaatgatgcgcgcgttatacagcactttacccgaagagtgagttttacctttgtcggagtcaaagaagacgcccggactacggtgcagctgagaaacgataacacgctcagtaccgttgataacaaaggtaccgttgtcggtcatgagcggaatttcgcccatgtagacttcttgttctttaatgtctttaacggtgccttccggcgcttcgcgctcgtagatcaccagacgcagttttacgcgcagcggtgcggaataggtcacgccacggatctgacattcctgaacgtcaaacaccggttcgccaaggcggtagctgacgtactgcagctcggaattaccgctgtagctctgaatcgggaacacggaacggaaggctgcttccaggccgtactgcccttcaggatcttgctcgataaacttctgaaacgagtcaagctggatagaaaggagataaggtacatccagaacttgtggacgtttaccaaaatccttacgaatacgttttttctcggtataggagtaaaccatagggttcctcagctcgctgacaagtcgacccatctgtcctgcgggggacagtttgtgcaacactattttgttgaccggaaaatggatactttccgcaatgcctgttgctatcacgcttaaaccatttcattgcgatttacacagaacgtacgctctgtcgcagtatattaagtcgtcgatagaaacaagcattgaaaggcacagcagtagtcaaacagtgtgaaacgctactggcgccttacagcgcaaaaaggctggtgactaaaaagtcaccagccatcagcctgatttctcaggctgcaaccggaagggttggcttatttaacttcaacttcagcgccagcttcttccagagattttttcagtgcttcagcgtcatctttgctcacgccttctttcagagcggccggagcagattctaccaggtctttagcttctttcagacccaggccagttgcgccacgtactgctttgataacagcaactttgttagcgccagcagctttcagaattacgtcgaattcagttttttcttcagcagcttcagccgggccagcagctacagctacagcagcagcagcggaaacaccgaatttttcttccattgcagaaatcagttctacaacgtccattacggacatagcggatactgcttcaatgatttgatctttagtgatagacatttaaattgttcctgaatatcagaataagtttatacgtaagcaaatgcttgataaagacaactgcgattacgcagcttcttttgcatcgcgtacagcagccagtgtgcgaaccagtttgccagccgaagcttctttcatggttgccatcaggcgtgcaattgcttcttcgtaggtcggcagagttgccaggcggtcgatctgagacgccgggatcagctcaccttcaaaggctgcagctttgacctcaaattttgcattcgctttcgcgaactctttgaacagacgagcagcagcgcccgggtgttccatagagtatgcaatcagggtcggaccaacaaacgtgtctttcaggcactcgaactgagtaccttcaacgacgcggcgcagcagggtgttacgaacaacacgcatgtatacgccagcttcacgacctgctttacgcagttcagtcattttatctacagttacgccacgggaatccgcaactactgcagacagcgcgcctttggctacttcgctgacttcagcaacaatcgcttgtttgtcttgaagatttaaagccattagctttgctcctggatgtttgccggaactcatgttccggaactcacttcactcatctcaacgagaagagcgtcttaatacggtgagcagaaacaagccagagtatcaaaaataatcttagcgttctgtcaccgtctacgcaggggattaagcctcttgcgagacgcctgcggtcttcgacggaggcctggataggccaggctccaacgaacaaatcttttctatccgtcgctattcagcttgtgacggcgttggcttccttcgttcgcaccagtcacatagttatctatgctcctggcgactcactaagttgccgccttgtcacaacccgaatacctcggatatacgtctgcaactagcagaatacgtgggggtaagattgtagacaaaatcaccgcccacgtaaagactaatcttagttcgcagatgcgctcagaccagcctgatcaacggcaacgccagcacccatggtggtggagatgctaactttcttgatgtacacgcctttcgcctggctcggttttgcttttttcagcgcaaccagcagagcttccaggttttctttcagtttgtcagcgtcaaagtccactttaccgatggtggtgtggatgatgccgtttttgtcgttacggtaacgaacctgacctgctttagcgttcttaaccgcttcagcaacgttcggcgttacggtaccgactttcgggtttggcatcaggccgcgcggacccagaacctggcccagctggccaacaacgcgcattgcatccggggatgcgataacaacgtcgaagttcatttcgcctttcttgatctggtcagccagatcttccatacctaccagctcagcgccagcagctttagctgcttcagcgttcgggccctgggtaaatacggcaacgcgaacagaacggccagtaccgtgcggcagtacagtcgcgccacgaacgttctggtcagatttacgagcgtcgatgccgaggttaacggcaacgtcaacgctttcgttgaatttagcagtggccagctctttcaacagggcaatagcttcgttgatgtcgtactgtttggtcgcatcaactttttcacggatcacgcgcatacgcttggtcagtttagccatttcttagtcctccactaccaggcccatggaacgtgcagtaccttcgatggagcgagtcatcgcttcaatgtcggcaccggtcatgtcggcagctttggtctgcgcgatttcctgcagctgagcgcgggaaattttacctactttgtctttgttcggcttgccggaaccagacttgataccagccgcttttttcagcagaacagctgccggaggcgttttggtaacgaaggtgaaagaacggtcagcgtaaacggtaataacaaccggaatcggcagacctttttcgatggaatccgtttttgcgttgaacgctttgcagaattccatgatgttcacaccctgctgacccagtgctggaccaaccggcggactcgggttcgccataccagctgcaacctgcagcttgacataggcttgtactttcttagccattctaaattcctcgaattgggtagtatcgcttcaaagaagctccccgtgataaatatcgctttatgggcataaggcccataaaaacaaaaggcgcgaaattgtatgtcaattttgcgccctatgcaacgattagatcgctgcttttttgatcgcagccttacgctttctcaacctgactgaagtccagctctaccggggtcgcacgaccgaagatagaaacagacactttcaggcgagacttctcataatcgacttcttcgacaacgccgttaaagtctgcgaacggaccgtcgttaacacgaaccatttcacccggttcaaacaacgttttcggccgcggcttatcgccaacctgctgcaggcggttcatgatcgcatcgacttctttgtcgctgatcggcgccggacggtcagaggtaccgccgataaagcccatcacacgcggcacgctgcgcaccaggtgccagcttgcgtcgttcatgaccatctggaccagaacgtaacccgggaagaatttgcgttcgcttttgcgacgctggccgccacggatctcaacgacttcttcagtcggcaccatgacttcgccaaacagctcttccatattgtgtaatttgatatgctcgcgcagcgatgtggctacgcggccttcaaaaccggaaaacgcctgaacgacgtaccagcgctttttaggtgcttcagacatctcagaacctcaggccagtgataaaggataccaggcgaaccagaataccatccagtccccacaggatcagtgacataactgcggtaaccgcagcgacgatcagcgtggtgtgcagcgtttcctggcgagtcggccaaatgaccttacggacttcggttctcgcttcacgggcaaaagcaacggttgctttaccttttgtcgtcaacagcgcgacaccacccgctgcaacaatcagaattactacggccagcgcacgcagcggcagcatcatgtcgcgatagaggtagttgccgacgattgcgacgatcagcaatatggcaacaactatccacttcatcgcttccaggccgcgcccgctcccttgagcttcggtattcgcactcataaaccaacctgtcagaagtattctacaaacattttcaccccgcaatcgcgaggcaaaccaaatcgaaacgcttattcgcctttcggattatacgccctctacagagcctgtctcagcaatgattatgacaaataaaatcactgatgagccaggttctggtgtgaaagcgtgcaaaaagggcatcaaatgatgcccttttattgcgcattgcgtcaaatgttatcagcgattagccgagaactttagcaacaacgcccgcgccaacagtacggccgccttcacggattgcgaaacgcagaccgtcgtccattgcgatcgggtggatcagggtaacaaccattttgatattgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttagtgtgcggcttgatggtgcccggcttagccagtacctgaccacgttcgatttcttcacgtttgataccacgcagcagaacacctacgttctcaccggcacggccttcgtccagcagtttgcggaacatttcaacgccagtacaggtagacttctgagtctctttgataccaacgatttcaacttcttcgcccactttgatgataccgcgttctacacgaccggtaacaacggtaccacgaccggagatggagaatacgtcttcgatcggcagcaggaacggcttgtcaatcgcacgctctggttccgggatgtaagaatccaggaagccagccagttcgatgattttcgcttcccactctgcgtcgccttccagcgctttcagagcagaaccacgaacgatcggcgtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgggtctgcggcatcgggccgtcagtcgcagcaacaaccaggatcgcgccgtccatctgagcagcaccggtgatcatgtttttaacatagtcggcgtgccccgggcagtctacgtgtgcgtagtggcgggtcggggtatcgtattcaacgtgagaagtgttgatggtgataccacgcgctttttcttccggcgcgttatcgatctggtcgaatgcgcgggcggcaccgccgtaggttttagccagtacggtagtaatggcagcggtcagcgttgttttaccatggtcaacgtggccgatagtaccgacgttaacgtgcggttttgtacgttcaaacttttctttagacatcgattgtccctctaagacacggataaatcggtgatatcaccacatcaaccaggcaacacgcccgacttgttgaatgctaataaacagaagagaaaaacaggaaggagaaaagaagtggtgctgataggcagattcgaactgccgacctcacccttaccaagggtgcgctctaccaactgagccatatcagcacatcttggagcgggcagcgggaatcgaacccgcatcatcagcttggaaggctgaggtaatagccattatacgatgcccgcatcctggaactcggctacctgattttcattctgcactgaatatcgagagaaactctctttattcgagccggtaagcgaacttatcgtctcgggctgcgccatcgcgcggccgaaaatggtggtgggggaaggattcgaaccttcgaagtctgtgacggcagatttacagtctgctccctttggccgctcgggaaccccaccggacttgatggtgccgactaccggaatcgaactggtgacctactgattacaagtcagttgctctacctactgagctaagtcggcatcaagtagcgcgcattctatggagacctgcgtgctcatgcaactaaaaaattgcataaaatgttctatcgctcacattttgcgctataagagacaaaaatgctctaatttcaaacaagagagcataaattttcggcattttaccaaccgtctgaccaggatacgacgcggcatttcaacgctccgtcgatagaaagcaatcttctgtatctggtatattcgtcacattgcttctcagggatagctttcacagcgagattttttcttattattcctccccatctggtgttaccctcctgcccattgtccaaattaacttaaatgtgacgtgccgttgcatgtcagggatggccctcgttcatcgctgaactgatgtagcaatagcagccagaaacatgcttatgagtataaaagagcaatcgttaatgacgccttacctacagtttgatcgcagccagtgggctgcgcttcgcgattctgtgccgatgaccctgaccgaggatgagatcgcgcagttaaaaggcattaatgaagatttatcgctggaagaagttgcagaaatatatttacctctctcccgtttgctaaatttctatatcagttcaaatctgcgtcgtcaggctgtcctggaacagtttctgggcactaacggccagcgaatcccttacatcatcagtatcgcgggcagcgtcgcagtgggtaaaagcacgacagcacgcgttctgcaagcgttgctgagtcgctggccggaacaccgccgtgttgaattgattaccacagacggcttcctccacccaaaccaggtgttgaaagaacgcgggttaatgaagaaaaaggggttccccgaatcgtatgatatgcaccgactggtgaaattcgtttctgacctcaagtcgggcgtaccgaacgtgacggcgccagtctattctcatttgatttacgatgttattcctgaaggggataaaaccgtcgctcagcctgatatattgattcttgaaggtttgaatgttttacaaagcggtatggattatcctcacgatccgcaccatgtatttgtctctgatttcgttgatttctctatttacgttgatgcgccagaagaacttcttcagacgtggtatatcaatcgcttcctgaaattccgcgaaggggcgtttaccgatcctgactcttatttccacaattatgcgaaattatctaaagaagaagctgttaatacagcagcttcgctttggaaagaaattaactggttgaatttaaaacaaaatatcttacctacgcgagaacgtgccagccttattatgaccaagagcgctaaccatgcggtggaacaggtaagattgcggaaataacagaaaaaaggggagtaccgactccccttttttactattcggcgcttcgcagcgatatttctccgcccatccagggtttaatcacgccatcctgttcaagcaataatgcgccctgagtatcaatgccgcgggaaataccaaatatttctttgtcgccaataattagttttaccggacgatcaataaaattatccagttttttccagcgcgaaagataaggagaaagaccttcttgctcaaaaagctcaagcgcagcacgtagcttataaatcagctttgcggccagcatattgcggtcgagcgtaattccggcctcttgtagtgtgatccatccctgatttatcacgtcctcttctacacgacgcattgccatgttaataccagcgccaatcactatttgtgcggcatcgcccgttttaccggttaactcgaccagaatacccgccagtttgcgatccagtaggtaaaggtcgttaggccacttcacacgaactttatctgcgcccagttcacgcagcacttccgccatcacaattccaatgaccagactcaagcctattgccgccgcaggcccctgctccagacgccagtacattgaaagatatagattcgcaccaaacggtgagaaccatttacgcccgcgacgaccacgccccgcctgttggtattctgctacacaggcatcgcctgaacgcagctcgccaattcgatcaagtaaatactgattggttgaatcgataacgggcaataccgccacgtttccgctatccagttggctatgtatacggtcagcatccagtaactggatgggttccggtaagctatatcctttcccgggaacggtaaatacatctactccccagtcgcgtaatgtctggatatgtttattaatagccgcacggctcattcccagccgttcacccaactgctcgcctgagtgaaactctccgtcggcaagtagtgagatcagcgtcaggggaacggtagtatctttcatgcaatgctctccacagcgttcacctctccgaactgaccaataaagcgaacctcaggctccagccagacattaaatttttcacccactttttgccggacatgatgcgccagcgccaccacatctttacttgtcgcatcattcgcattaatcaataccagcgcctgttggcgatgcaccgcagcgccgccaatggtgacgcctttcaactgacattgatctatcagccagcctgccgccagcttcactgagccgtctgcctgagggtaatgcggcgcgttgggaaatcgttctaacagttccatagcgatatcggctgcgacaacgggatttttaaaaaagctgcccgcattgccattcactttaggatccggcaattttgtggtgcgcatatggcatacagcatcaaacacctgttgcgcggtgaccgttttcgggtccagacgagtaagatcgccataggtcaacaccggctgccattgctttgacaaacgcagacccaccgcgacgatcgcaacgcgatcctgatattcatttttgaagatactgtcacgatagccgaaacggcattccgccgcggacaaacgcagacgttttcccgtttccagttcaacgcagtcaacgtagtcgcagacgcgatgtagttctacgccatacgcgccaatattctgtataggcgaggaaccaacgcagccagggatgagcgccagattctccaggccgggcatgttgttgtccagcgcatagcgaaccagctgatgccagttttcgcctgcgccgacgtgtaggtgccaggcgtccgcggtttcattcacctcaatgcctttcaggcggttaaggatcacggtgccggcgtaattttccagaaacaggacgttgcttccttcacccaggatcataaccggcagtccctcacgagttgcttgctgccaggcgctcagtagttgttgttcgttttcagcgcatacgatgtgctttgcacaatgatcaatgccgaaggtattccagggttttaaggaatgggtcatggctgctttcctgatactcaatcggcaatagtttaccgtatctgggttgggaaggcttgcggttatgtcgacggaataaggcggtgtacacaggcattgtgccgaacttgccgtaggccggataaggcggagccgccatccggcggtgcaggttgcctgatggcgctgcgcttatcaggcctacatttttacagttaccacacatgcaaaaaagcccatccgtcaggatgggcttcttcactaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacttaaaggctcagggagaactcatctcggggcaagtttcgtgcttagatgctttcagcacttatctcttccgcatttaggctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaacactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcagtgccgcttcgctttttctcagcagcgcggggtgtgcatattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataatttctcaagtgcctggtatttacccaaaacgccattaaaccgccagtttttcgagcgtttcaaagccataacgctgtaaaacgggtaataattgttcagctcctggcgtcattgccatgcaataagcaatattggcatcggttgatttcgcatccggcgcttcatgttccaacagccaggctgtacgacgcgctatcgccgcgccggaatccactaaccgcgtcccttcgggcaggacttgcaaaagctcgtcccgtaatagagggaaatgcgtacaccccagaacgaccgtgtcaggcggctccggcattcgtagccatgggcgtaatatacggcgcagttcttccagcgataccgaatcgccatgtaatttagcttccgccagttccaccagttctgccgaccccaacatcgctatctgacattcattggcgaagcgcgcaatcagctcgtgagtataaggacgtttgaccgtggctctcgtcgccagtagcccgacgacgccattggcggtaagccgcgccgctggtttaatcgcaggcacaacgcccaccaccgggaaggcaaacttttcacgtaatgcgggaagtgagaccgtactggcggtattacaggcaatcaccgccagtgaaaggggatagcgctgctgtaccgcagtcacaatctcgacaacgcgctcaacgataaacgtttcgctcttttccccgtaggggaaagccacgttatcgaaagcatatatatagtggagatccggcaggagccgccgaatctcatcatagaccgacaatccaccgacgccggaatcaaataccagcacggtgggacgtggttcagaaggtgtagctgccagacaaggtgtattctcgtcctgcagtttggtagccataaactgtctcgtaatctttgtcgaacaggttggctattttaccacgaactgtcagatgtgaggtgaccggatatgcaaccgtaagatcccataaactgacgccgcccatttttactgtccggtatgggtaagcggagtaatccgaatcatagcgggaaccaaggtattgatatgtcaccccccagtcaaaatcgtaaacgtcccagtcaagttgatattttgccatctgtttggaacgccggggtaatggcgtatcggtaatcgcattacgcgcatcaacgtaatcataactgaccgtatgcgttaacggtccggtatcgaaattcgccgtcgcctcaatacctttaatacgcgccttaccttcgttgtaatatttttgcagatgatcgtcataatcgatcatgtcattaatatcgttacgataacctgaaatacgccagctgacgccagcggtgagcccttcaaatgcgccttcccactgtttactcttttcaggattcaggttcggattaccgtaatacccatacagctggcccaaattaggcgctttgtaggaggttccgtaggaggcaataaagcgataaccttctataaactcccatcccgcgctggtttgccatgtaccgtgacgaccaaactgggagttgtcatcactgcgcgccgccgcttccagggtgaagtcacccaactgttgtaatcctgtcaggtaaaccccggtattacgctggtcatatccctcgggcacatagccggtacctggcgtggtagtctgtttctgccagtctacgcccgccccaacattaccgtgccccacaaccacactgttggtccattgaacattgtactgtttcatctcatccagcgtggcggaggtatcataccgaccatagtgcggatcatagttgtaatctttactgtggctatagcttgaaactagctgagactgaatacgttcgccattaaagcgcagcccggcgtcccagctttggctataaagtttgcgtgtatcaatcagcggcgagcccggcgagtaataggcgtcgtaatcggtacggttatcgtagccataaccacgcacgaatccgctccagcgatcagaaaaggtatgctctaacgcgccataaagcgttttactcaaaaagccgtcccggtcaggctgcgcctgcatcccggtaccgcctttcgctaccacgtcaaaccctttggtgtattcgtaatcgccgatcaacgtcgcccgcgtgttttcgccaagttgctgttgcgtcgagaggtcgtaattctggtagctattgcttccccatccagcggttaattctgtgcctgggttatcgcgcgtcgtaatgatattcactacgccgccgatagcatcggaaccataaatagcggaacgcggaccgcgaatatattcaatgcgctgtaccagcgacaccgggaactggctgagatcggcggacccgctcacgcctgctaaattcagacgcacgccgtcaatcaataccagtacatggctggagttggtgccgcgaatgaaaatggaggagttttgtccggtgccgccgctctgcgcaatatcgacgccaggcaaacggcgtagaacatcatttacggaggtcgattgccagcgttcaatatcctgacgcgtcacgatggtaacgggcgccagaaccgcgctgcgcggctgctgaaaacggttggcggtgacaaccagtgtatccgggctagtgtcctgcgcccaagctgaaaaggccgtgacggagaacgccgtcagcagcgtagcttttttaatcattgtaaagcatccacaatataagaaggatgccgcaggcttcatcgatagtacgcgatgatgaaaaaccagatgcgacgttagccggcaggtcttcgggcttggagggttatccgttgactggatagcagaaatgatgacttcccgccggaggcagtgtctgcttacgctctcatctcacctttccttaccgctgcgcgtcagctccagattttcactggattccctattaactcacaggaccggcccacggatgctaccgtctgtcacaacaccctgtccagaccgcgcatcacaaatcagaaatcatcaatagctggacatccactgagcaatccctacaatccccgcgtacttttattattcaggatgcgatatgacccccgaacatcttccgacagaacagtatgaggcgcagctggccgaaaaagtggcgcgcttgcagagtatgatggcgccgttttctggcctggttccggaagtatttcgctcgccggtcagtcactatcgtatgcgtgcggaatttcgcctgtggcatgacggcgataacctgtaccacattatgtttgatcagcagaccaaaagccggattcgcgttgacaccttcccggcggccagccaactgattaataccttaatgaaggcgatgattgccggcgtgcgcgataatcatgcactgcggcataagctgttccagatcgattatctcacgaccttgagcaaccaggcggtagtgtcgttgctgtaccataagaagctggacgaagagtggcgtgaagccgccactgcgttacgcgatgctttacgcgcgcaaggtctgaacgtacacctgattggccgggctactaaaaccaagatcgaattggatcaggattatattgatgagcgtctgcctgtggcaggtaaagagatcatctaccgccaggtcgaaaacagctttacgcagccaaacgccgccatgaatattcagatgttagagtgggcgctggaggtgacgaaagactcaaaaggcgatctgcttgagttgtattgcggcaacggcaatttttctttagcgctggcgcgcaattttaaccgcgtgctggcaaccgaaatcgccaaaccgtccgtcgctgccgcacagtacaatattgccgctaatcatattgataatgtgcaaattattcgcatggcggcggaagagtttacccaggcgatgaacggcgttcgtgagtttaaccgcctgcaggggatcgacctgaagcgctatcagtgcgaaaccatttttgtcgatccgccgcgcagcggtctggacagcgaaacagaaaaaatggtgcaggcttatccacgtattctgtacatttcctgcaatccggaaacgttgtgcaaaaacctggaaacgttaagccagacgcacacggtgtctcgcctggcgctattcgatcagttcccgtatacgcatcatatggaatgcggggtattactcaccgcaaggtaaaatgtacgtcggatggccggttataccgccatccggcattcgcacactactccgcggtgtcctgcttgcggttacgcagcttaaagccaatccagaataccagaatcaccgacagcaccgccgggaagaaattagagccgatatccggatattctgcacgcacgacagtgctatacagtaaaacgccaagaatgaaacaagcggcggccaaccccggcaaacctaccggcatagtacgattttggtagcgctgatgcaggcaatataccgtcagtaccagcgagataaccgggaatacggagaacggcacaatagcgctaaacaacgccgcgaatgtgccgttaatcgataagccagcgatgagcgccagcaacagcgtacctttatcttgacctgactgtttcattactcgtccttcacgttattcggaatgatgtgctattttctcttgctcacggcgataccagtaatacgcccctttcgcaatcatgcgcagttgcaataccagccgctcttctaattgccgacgctgttcagcgccgatgtccaacgcctctgcgcccgcgctaaagacaatagtcaccatcgcttcggcctgggcttcagtaaacgcgcgcggcatatggttttcgagttccagatagtcggcaagttccgcaataaaatgctgaatctcccgcgcgacggcggcacgaaacgccgcggaagtgccggaacgctcgcgcaacaacagacggaaggcgttgggattgttgccgataaactccataaatgtagagaccgacgtgcgaatgacgctgccgcctttcgcgatacgctgtcgcgcctgacgcatcaactgacgcagcatcagaccgctttcatccaccatcgttagaccgagttcatcgacatcgcgaaaatgacggtaaaacgacgttggcgcaatgcccgcttcacgcgccacctcacgcaaactcaggctggcgaaacttcgctcagcgctcagttggctgaatgcggcttccaccagcgaacgccgggttttttctttttgttgcgctctaacacccatcacaatgtctgaatccttccatatgccttattcggcactataccagagaataaaagtaacgggttcacactggattgtgaatgattgtttacagacagtttgtgctccggcttcgcaaaaaagcacaacgataattgggttaaagctgggcaaatgttatcatcgtgtttattttatgtataaaaacaggtgagtaataccatgccacattcctgggattatgatgcagtcgtcatagggtcaggccccggcggtgaaggcgctgcaatgggtctggttaagcaaggagcacgcgtcgcggtgattgagcgttatcataacgttggcggcggatgtacccactggggcaccattccatccaaagcccttcgccacgccgtcagccgcattattgaatttaatcaaaacccgctctatagcgaccactcccgtctccttcgttcttctttcgccgatatccttaatcatgccgataacgtgattaatcaacaaacgcgtatgcgtcaggggttttatgagcgtaaccactgtgaaatcttgcagggcaacgcccattttattgacgaacataccctggcgctggaatgccatgacggcacggttgaaaccctgacggcagaaaaatttgttattgcctgtggttcgcgtccttaccatcccaatgatgtggatttctcgcatccgcgcatttatgacagcgactcaatcctgagtctccaccatgaaccgcgccacgttattatttacggcgcaggcgttatcggctgcgaatatgcgtccatattccgcggtatggatgtgaaagtggatctgatcaacacccgcgatcgcctgctggcctttctcgatcaggagatgtccgactctctctcttaccatttctggaatagcggcgtggttattcgccacaatgaagagtatgagaaaatcgaaggctgcgatgatggcgtcatcatgcacctgaaatccggcaaaaaactgaaggctgactgcctgctctatgctaatggccgtaccggtaacaccgattcgctggcgctggagaatattggtctggaaacagacagccgtggacagctcaaagtcaacagtatgtaccagaccgccctgccgcacgtctatgcggtgggcgacgtgattggctatcccagtctggcctccgccgcctacgatcaggggcgtattgcagcgcaggcgctggtgaaaggcgaagcgaccgcgcatcttatcgaagatatccccaccgggatttataccattccggaaatcagttctgtcggcaaaaccgagcagcagttaacggcaatgaaagtgccttacgaagtgggccgcgcgcagtttaagcatctggcgcgagcgcaaatcgtcggcatgaacgtcggcacgctaaaaattctctttcaccgcgaaaccaaagaaattctggggattcactgctttggcgaacgcgccgccgaaattattcatatcggccaggcgatcatggagcagaaaggtggcggtaacaccatcgaatacttcgttaacaccacctttaactacccaaccatggcggaagcttatcgggttgcggcgttgaacggcttaaaccgcctgttttaacgccttgtcgaaatgtccatccattgcgccacggatggcctctgccagttgctcataacggctacgcagcggcgatcccgggcgataaaccagccccacggtacgacgcggctccggcttaatgcatggcagataaaccacgccgtcgcgcttacgctcctgcggtacggccagcgcggggagtagtgtaataccactgcccgccgccaccatgttgcgcagcgtttccagactggtcgcccggaaatgggtatcttcatccgctcccgcttcaaaacagaaccccatcgcctgatcgcgcagacagtggccatcttccagcatcagcaatttctcgcccgccagatcggacatcggcacgcgatcgcgattcgcccacggatgatcttcataaatagccagcatcatgggctcatcaaacagcggcacttcgataaacgcctcgctctctttcaccagcgccagaatagcgcagtcaagcttgccgctatcgagttgcgctaacagctggtgcgtttgcgcctcatgcagatacatttccagcttcgggaaagtctggtgcaacattggaatgataagcggcagcaaatagggaccaattgttgggattaaaccaatatgcagcgggccggacatcgtctcgccttgttggcttgccatctccttgagcaccttgacctcacgcagtacggtacgcgcctgatccaccagcagtaagcccgcctgggtaaacagcaccttacggctcgtacgctccagcagcataacgcccagctcatcttccagcttacgtatttgcccactaagggttggctggctgacgtgacaggagtccgccgctcgccggaaatggcgatgttcggctaacgccaccagatattcaagatcacgaatattcattattcatcctccgtcgccacgatagttcatggcgataggtagcatagcaacgaacgattatccctatcaacctttctgattaataatacatcacagaacggagcggtttctcgtttaacccttgaagacaccgcccgttcagagggtatctctcgaacccgaaataactaaagccaacgtgaacttttgcaaacctctggtccgcttttttttgcgtaaaaaagcccggcgtcgctgatgctcggccgggcagtattacctgatggcgctacgcttataaggcctacaacgcgaggcgcaccttcgcatcgtcgatggcctgcgccacctgctgcggagaaacgccgccttttgccgcccgtttatccagacacgactgcaaagacaatatcggatacacatcgtcgccaatcacgcggctgaatttctgtaaatcggccagcggcaacgcttccagcggcttaccctggcgaatagcttctaccacagcttcgccgacaatatggtgcgcttcgcggaacggcacgcctttcgcgaccaggtaatccgccagctcggtggcgttggcatacccctgttgcgccgcgtcctgacaacgtgggcgtttcacctgaataccgtccagcaccaacgccgccatatgcaggcagtcaagccagatatcgagcgcatcgaacagcccttctttgtcttcctgcatatctttgttatacgccagcggcagaccttttaaagtcatcatcatgccggttagcgccccttgtacgcgaccgcacttaccgcgaatcagctccagcgcgtccgggtttttcttctgcggcattaacgatgaaccggaagtcacgcggtcagaaagctctacaaagcccgcttcaccagaattaaagaaaatcagatcttccgcgaaacgtgacagatgcaccatgccgatagccgcatcagaaagcagttccagtacgtggtcacgatcggacacgctgtccaggctgttgcgggtcgcagacgtgaagcccagccagcctgccaattgttcacggtcaatttcataggccgttcccgccaacgcgccgcagcctagcggactcacgtccagacgtttaagcgtgtcctgcaggcggctttcatcgcgcgccagcatttcgacatacgcgagacaccagtgggcgaaagtcactggctgcgcgcgttgcagatgggtatatcccggcattaccgcgtcctggttcgcctgcgcggtttccaccagcgcgctctgtagctggcggttagcggtgagcagttccatcaccgtctctttgcaccacagtttcaggtccgtcgccacctgatcgttacggctgcgcccggtgtgcagctttttacccaactgacccactttgtcgatgagcttaccttccacccagctatggatatcttccgcatcgctttgcaggatttgctgcggattcgcgcgaacctcttccagcagcacgttcagcgcttcttccaactgtcgttgctcatcggcagtcagtacgcctaccgtgaccaatgctttggaccaggccacagaaccgacaatatcctgctccgccagacggtaatcgaagcgcaacgaatcattgaattgtttaaaccgttggtctgccgcctgtgtaaaacgcccaccccaaagtgccataatagacttccttaaattcttcgaatttcactgccggatagcgctacgcttatccggcttacaatttctgttcacgtaggcccgataaggcgcagccgccatcgggcgaacaaatagttaagccagaatacgcgtgccaatcggcgtgccgttaaacagcgccggcaattgttccgcatgacgccaggaagcaatatccaccggacgacccagcgcccgcgcagcatcgagagccgcattcactttcacaatcatcccgtcggtaataatgccctggtcgataagctgttcggctttggacgccgtcatttcggcgatacgctggcctttgccgtccagaataccgctcacgtcagaaagcaggatcagatcggcccccagcgtcgccgccagcgcggttgccgcctgatcggcgttgacgttcatcagttggccgtcgtctgttacgccaatggagctgaccaccggcagaaagccgttttccagcaacatgttaatcagcttcggcgaccccggttgcgccagcccgacgtggcctaacgcttcatcgagttgggtcacgtttacgctgtcgccatcgcccagaaacagaccaacagaggcgatatggtgtttcttcgcccaagccagcagagttttgttagcggttcccgccagcgcaccggtaatgatgccaatctgatcggcaggcgtcacgcgcaggccgtctttctttttcactggcaaattaagccctttcatcagctcatccaccacgcaaccgccgccgtgaacaatcaccagcggacgctgatgggactcacgatagttgaccagcgcggtaaaaagacgttccagagcctcttcgctatccagtaatacgccacccagcttgataattaatggattcatcatttcacccttaaataagagactgcgtttcagcgaagccaaaacgaatattagcgcactgcaccgcctgcgccgctgcgcctttcaacaagttgtcttcggttgccaccacaatcagatgttcgccctggacggcaaaaccaatatcgcagaacggcagcccgacgacgttctttaacgccggaacgcctttgtcatacaggcgcaccagcggtttgtcgccataggctttttgcaacacgtcggcgacctgcgcatgggttactcccgctttcaggcggcaggtaatggtttccagaatcccgcgcgggaaattccccagatgcggggtgaagatgacctccgcgcccagatgggcagcgatttccggctgatgacgatgcgtaaacacaccatacggttgcaaactcacttcacagaaactgttcgatattgccgccttgcgccccgcgccgctcaccccgctggtggcattaattaccggccactgcgtcagatcgagaagcccgccgtcaatcagcggttttagcgacaactgcgctgcggttggatagcaaccaggaaccgcaatcagattcgccgtgttcagtttatcggcattccactccgccagaccgtacaccgcctgctccagcagctcaggatactgatgagtaaatccgtaatacttttcatagaaggcgcgatcgtttacccgaaacgcgccggaaagatcgaatacgacgcatccggcctgtaaaaactgcggcgccagatcgtggctcacttcatgcgctgtcgccaggaacaccacatcaacatctgcgctaaagtcacgtacatccgacatcggttgcaatggcaggtcaacaatcccttttaactgcggatgtaaatcagaaattaactttcctgcatcattgctttgcgctgagacggtcaaagcggttatggtcatatgtgggtggcgatttacgtagcttacaagctctgcgcccgcataaccgctagcgcctacaatcagcgtattcaacatcgggttcctttatgctcaacgttaatgtatttttattcataattaatgcatgaatattgatactatcatgacctgaggtgtgtcaacaatgaaaaacgttttaccgccatttatcgagatttaccgcgctctgattgccacaccgtcgataagcgcaaccgaagaatccctggatcaaagtaatgcgtctttaatcactttgcttgcaggctggttcagcgatcttggtttcaacgtagaggttcaaccggttccaggaacgcgaaacaaatttaatatgctcgccagcaccggacatggcgcgggcggtttgctgctgaccggccataccgacacagttccctttgatgacggacgctggacgcgcgacccgttcacgctgaccgagcacgacaataagctctatggtctgggcactgcggatatgaaaggcttcttcgcttttattctggacgcgctacgtgacgttgacgtcacaaagttgaaaaagccgctctacattctggcgaccgccgatgaagagaccagcatggcgggggcgcgttatttttccgaaaccacggcattacgtccggactgcgcgatcattggcgaaccgacgtcgttgcaaccgatacgcgcgcacaaagggcatatctctaatgtcgttcgcgtcctggggcagtccggtcattccagcgacccggcgcgtggggttaacgccattgaactgatgcacgatgcgattggccatatcatgcaactgcgtgactcgctgaaagcgcggtatcactacgaggcatttaccgttccgtatccaacgctgaatctgggccatatccacggcggcgatgcctcaaaccgtatctgcgcctgctgcgaattgcatatggatattcgtccactgccgggcatgacgttaaacgaccttaatggactgcttaacgacgcgctggctccggtaagcgaacgctggccgggccgcctgacggtggcggaattacatccgccgattccaggttacgagtgtccaccggaccaccaactggttgaagtagtagaaaaactgttgggaacaaaaaccgacgtggtgaactactgtactgaagcgccgtttatgcagacattatgcccaacgctggtgcttggtccgggctcaattaatcaggcgcatcaaccggatgaatatctcgaaacgcgttttattaagccaacccgggaattgattacccaggtagtacaccatttttgctggcattaatgcatattgcccggtgacacgatgtttaccgggcctcccccgtcttgtaggccgcataagcgcagcgccatccggcatctctacgccacatgttcataagcatttcttatttggcacgatgcgaattaactttaataaattaccgccattttttcgtttgctgaaccgatttcgcagtaattgacgccacgggttttacgtggctttataaaagacggctaaaaagcaaagtcagaaaaatttcacgtcacagcaaggcggcaaacgagcccattccgcagaactagcatacgggcgagcgcagccactgccgctgtggcatgaaagagacagggcaattacattaaagatggggtgtctgatggcatatgaacgaacaatattccgcgttgcgtagtaatgtcagtatgctcggcaaggtgctgggagaaaccatcaaggatgcgctgggagagcacattcttgatcgcgtagaaacaatccgtaagctatccaaatcttcacgcgccggcaatgaagctaatcgccaggagctgctcaccacgctacaaaatttgtctaatgacgagctgctgccagttgcgcgcgcgtttagtcagttcctgaacctggccaatactgccgagcaataccacagcatttcgccaaaaggcgaagccgccagcaacccggaagtgattgcccacactctgcgtaaactgaaaaaccaaccggacctcaacgacgcaaccatcaaaaaagcggtagagtcgctgtctttggagttggtgctaaccgcccacccgacagaaattacccgccgtacgcttattcacaagatgggggaaatcaataactgtctgaaacagcttgataataccgatatcgccgactacgaacgccaccaggtgatgcgtcgcctgcgccagttgattgcccaatcctggcatacggatgagatccgcaagcagcgcccaagcccggtggatgaagccaaatggggcttcgccgtggttgagaacagcctgtggcagggcgtacctaactatctgcgtgaactgaatgaacaactggaagaaaatctcggctacaaattgccggtggattttgtgccggtacgttttacctcctggatgggcggcgaccgagacggcaacccgaacgtgacggcggagatcacccgccacgtactcttgttaagccgctggaaagccaccgatctgttcctgaaagacattcatgtcctggtatcagaactgtcgatggtcgacgccacgccggagctgctggcgttagtgggcgaagaaggcgcgtctgagccgtatcgctacctgatgaaaaaattgcgcgcccgtctgatggcgacccagtcctggctggaagcgcgtctgaaaggcgagaagctgcccaaaccggctggcctgctgacgcaaaacgagcagctctgggaacctctgtacgcctgctaccagtcgttacaggcctgtggcatgggcattatcgccaacggcgagttactcgacacgctccgccgcgtgaagtgtttcggcgtaccgctggtgcgtattgatatccgtcaggagagcacccgccataccgaagcgctgggcgaaattacccgctacctcggtattggcgactacgaaagctggtcggaagccgacaagcaggccttcctgatccgcgagctgaactccaaacgtccgctgctgccgcgtaactgggagccgagcaacgatacccgcgaagtgcttgaaacctgcaaggttattgccgaaacgccaaaagggtcgatcgccgcctacgtgatttctatggcgaaaacgccgtctgatgtgctggctgtgcatttgctgctgaaagaggcaggtatcggctttgccatgccggtcgcaccgctgtttgaaaccctcgacgacctgaacaatgccgacgacgtgatgacccagttgttgaatatcgactggtatcgcgggctgattcagggtaagcagatggtcatgatcggctactccgactcggcaaaagacgccggcgttatggccgcgtcatgggcgcagtatcaggcgcaggacgccctgatcaaaacctgtgaaaaagccggcatcgagctcactctcttccacggccgcggcggctctattggccgtggcggcgcgccagcccacgcggcgctgctttcgcaaccgccaggcagtctgaaaggcggtctgcgcgtgaccgagcagggcgagatgatccgcttcaaatacggcctgccggaagtcaccgtcagcagcctctcgctctacaccagcgcaattctggaagcaaacctgctgccgccgccggaaccgaaagacagctggcgtcatattatggatgagctttccgtcatctcctgtgaaacctaccgcggttacgtgcgcgaaaataaagactttgtaccgtacttccgctccgcgacgccggaacaagagctgggcaaattgccgctcggctcacgtccggcgaaacgtcgtccaactggcggcgtcgaatcgctgcgcgcgattccgtggatcttcgcctggacgcaaaaccgcctgatgctgccagcctggctgggcgcgggtactgcgctgcaaaaagtggtggaagacggtaaacaaagcgaactggaagccatgtgccgcgactggccgttcttctccacgcgtcttgggatgctggaaatggtgttctcgaaagccgacctgtggctggccgactattacgatcagcgcctggtggcgaaaacgctttggccgctgggcaaagagctacgagacctactggaagaagacattaaagtggtgctggcgattgccaacgattcgcacctgatggccgacttaccgtggattgcggagtccattcagttaagaaacgtttataccgatccattaaacgtgttgcaggccgaattgctgtatcgttcccgtctgactgaagagcagggcaaatcgcccgatcctcgcgtcgaacaggcgttgatggtcacgattgcgggcgtcgccgccggtatgcgcaacaccggctaacgccaaaagaaagccgccctcacgcagttatgtgggggcggcatgaaatactgctgtcatcctcgtcattttttcaatatattcctgtctgcatttataaatctttcttagcaaaacgtgcggcataaagcaggtttgcttcagattcttttaaggttcaggcgttacgtttggcgctacgattaaagacaggctctcattatgcaatccacattactccagactaaacccgcgtttagctggaaagccctgggctgggcactgctctacttttggttcttttccaccctcctgcaggccattatttatctcaccggatacagtgggacaaacggtctgcgggattcgctactgtacagctcactatggctgatcccggtctttttgtttccaggccgcatccgggttattgctgccgttattggcgtcgtactctgggccgcctcgctggcggcgctgagctattacgtaatctacgggcaggagttctcgcaaagcgtgctgtttgtgatgtttgaaaccaacgccaatgaagccagcgaatatttaagccaatatttcagtctgaaaattgttcttgtcgcgctggcttatacggtggcggcgattttgctgtggacacgtctgcgcccggtttatattccatccccctggcgttatctggtgtcgtttgccctgctgtacgggctgatcctccatcccatcgcgatgaatacctttatcaagcataagtcgatggagaaaacgctggatagcctggcgtcacgaatggaacccgccgctccgtggcaatttattactggctactatcagtaccgtttacagctcgcctcgctgaataaactgctgaatgaaaacgatgccctgccgccgctggctaacttccaggaccactccggcgatgcgccgcgcacactggtactggtgattggcgaatcgacccagcgtggccgtatgagtctgtacggttatccgcgcgaaaccacgccggaactggacgcgctgcataaaaccgaccccgggctgaccgtgtttaataatgtggtaacttcgcgaccgtacaccattgagatcctgcaacaggcgctaacgttcgcggacgaaaagaacccggactggtatctgacgaagccatcgctgatgaatatgatgaaacaggccgggtataaaaccttctggatcactaaccagcagacgatgacggcgcgtaataccatgctgaccgtgttctctaagcagactgataagcagttctatatgaaccagcagcgcactcaaagcgcgcgcgaatatgacagcaacgtgctggcgccgtttaaagcggtgttagccgacccggcgccgaaaaaattcattattgtgcatctgctgggaacgcacattaaatacaagttccgctatccagaaaaccagggcaagtttgatggtaaaaccgaccatgttccgccgggattaagcagcgacgaactggaatcgtataacgattacgacaacgcgaacctgtataacgactatgttgtcgccagcctgattaaggactataaagcgaccgatccgaacggtttcctgctctacttctccgaccacggtgaagaagtgtatgacacgccgccgcataagacgcagggacgaaacgaagattcgccaacccgtcatatgtatacggtgccgttcctgctgtggacctcagagaaatggcaggcggcgcatccgcgcgacttctcacaggatgtcgatcgtaagtacagcagttccgagcttatccatacctggtcggacttagcgggcctgacctatgatggttacgacccgacgcgttccatcaccaacccgcagttcaaagagaccacgcgctggattggcaacccgtataagaaaaacgcgctgattgattatgatacgttgccgtatggcgatcaggtcggtaatcaatagcctgtatgttgcccgataacgctaacgcttatcgggcctggcgttcttctctcccgtagtccggataaggcgcaaagcgccgctatccggcaataattgcttgaggacatcggttttcgacgttactgtttcctctgtttgcgatcggcaggggattatcatgtatcacgacgtcagccaccttctctcccgtctcatcaacggcccgctgccgctgcgtcagatttattttgccagcgccagcggcccagcgccggaactggcgtaccaggtggattttccgcggctggagattgtgctggagggcgagcttactgacatgagcattaccgccccgctcattccttgcgatgttctctacgttccggctggcggctggaacatcccgcagtggcaaacgcccgtcaccaccctgagcattctgtttggcaaacagcagttaggtttcagcgtggtctactgggacggtcagcagcatcaaaacctcacgaaacagcacgttgcgcgccgtggcccgcgtatcggctcgttcctgttacaaacgcttaatgagatgcagatgcagccgcaagagcagcaaacggccagattgattgtcgccagcctactaagccattgccgcgatctgctcggcagccaaatccagaccgcctcccgtagccgtgcgctttttgaagccattcgggagtatattgatgaacgctacgccgcgccgttgacgcgcgaatcggtagcacaggcgttttatatctcgccaaattacctctcgcacctgttccagaaaacgggagccatcggctttaacgaatacctgaaccatacgcgactggaacacgccaaaacgttgctgaagggctatgacctgaaagtgaaagaggtggcgcaccgctgcggctttgtcgacagtaactatttctgccgcctgtttcgcaaaaatacggaacgttcgccttcggagtatcgccgccagtatcacagccagctaacggagaaataatccacacgccaataaagagaatacagtagataaaacgcgcatttactggattattgtaatatcaatgcaaaaacctcactcccccacatggcatacaacagcacgttatacgttaatcatcaccaacttgtgaagtaaatcacactttaccaagagcatcacatttgtccagtttttggcagatttgtcacatagcgcatccggggcacgctcctttatcctgtccataacgaaaactcacgaagagaaagactatggaactctatctggataccgctaacgtggcggaagttgaacgtctggcgcgcattttcccgattgccggcgtcaccaccaatccaagcattgtggcagccagcaaagaatctatctgggatgtgctgcccaggctgcaaaacgccatcggcgaagaaggcactttatttgcgcagaccatgagccgcgacgcgaaagggatggtggaagaagccaaacggctgaataacgccatccccggcattgtggttaaaattccggtaaccgccgaaggccttgcagcgattaaattgctgaaaaaagaaggcatcgtgacgctgggcaccgccgtctacagcgcgtcgcagggcctgctggcggcgctggcgggcgcaaaatatgtcgctccttacgtcaaccgcgttgatgcgcagggcggcgatggcattcgtatggttctggagctgcaaacgctactggaacatcacgcgcccgacagcatggtactggcggccagctttaaaacgccgcggcaggcgctggattgcttactggcaggttgccaggcgattacccttcctttagatgtagcgcaacaaatgctcaatacgcctgcggtagagtcagcaatagagaagtttgagcaagactggaaaaacgcttttggtaatctgaacctgtaggagagaaatgtatggatcgcattattcagtcaccaggtaagtatattcagggtgcaaacgtcatcgcgcgtcttggcgattatttaaaaccaatggcgaacaactggctggttgtgggcgataaattcgtgctgggatttgccgaagagacgctgcgcaaaagcctgacggatgccggtttgtcagtagaaatcgccccgtttggcggcgaatgttcgcaaaatgagatcgacaggctgcgcgccgtcgccgaaaaaagtcagtgtggcgccgtactgggtatcggcggcggtaaaacgctggataccgccaaagcgctggcgcactttatgaacgtcccggtcgctatcgcgccgaccatcgcctctaccgacgcaccgtgcagcgcactctcggttatttataccgatgccggtgagtttgaccgttatctgctgctgccgcataacccgaatatggtcattgtcgatacgcagatagtggcgggcgcgccggcgcgtctgctggcagccggtatcggcgatgcgctggcgacctggtttgaagcgcgcgcctgctcacgcagcggcgccaccacaatggcgggcggcaagtgtacacaggccgcgctggccctggcggagctatgctataacacgctgatcgaagaaggcgaaaaagccatgttggccgccgaacagcacgtcgtcacgccagcgctggaacgtgtcatcgaagccaacacctacctgagcggggtcggttttgaaagcggcggtctggccgcagcgcacgcgattcataacggtttaacggcgattccggatgcgcaccactattatcacggggagaaggtcgctttcggtacgctgacgcaactggtgctggaaaacgcgtcggtcgaagaaatcgaaaccgttgctgcgctgtgccattccgttggcctgccgattacgctggcgcaactggatattaagcaggatatcccggccaaaatgcgcatcgtcgcggaagcctcctgcgcagaaggtgaaactattcataacatgcctggcggcgcaacgccggatgaagtgtacgccgcgctgctggtcgccgaccagtacggtcaacgcttcttgcaggaatgggaataaggtcggcttgcaatgaaaaatccccgcaattgcgcggggatttttttgcccggtgggcatatgagacggtaggccggataagcgttagcgtcatccggcataagatttacaacagatcgaaacggtccaggttcatcactttcacccatgccgcgacgaagtccttcacaaacttctcgtgcgcatcgctacacgcgtaaacttccgccagcgcgcgcagtacggagttggaaccaaacaccagatcggcgcgggttgccgtgtattttacctcgccagtcaggcgatcccggccttcgaacagctcattagcgtcgtcggtgggcttccactcgtaacgcatatccagcagattagcgaagaagtcagtgctgagcacgcccggtctgtcggtaaagacaccgttctggctgccgtcaaagttggttcccagcacacgcatcccgccaaccagtaccgtcatttccggcgcggtcaacgttaactgctgcgctttatcaatcaacagcgattcggtcgtcgacacatccagacgcgcacgatagttacggaatccatcggcaatcggttcaagcagcgagaacatctcgatgtcggtctgatcctgacgcgcatccacccggcccggcgcaaaaggtacgctgatgctgacacccgcagcagcggccgcctgctcgataccgaccacgcccgccagcacaataatatcggccagcgaggctttattcgtcgttttctggagcgcttctaataccggcagaacgcgagccgcaacggcgttgacctcccagtcgcgctgaggcgctaatgccagacgcgcgccgttagcgccgccacgcttatcgccgccgcggaaagtagacgcggatgcccaggcaaccgaaaccatctcgctaatagaaagcccggatgcagcgatcgccgctttcaggttgataatgtcttcctgcgttggctggtagagcggttgcggcaacgggtcctgccagatcagatcttctttcggcacttccggtccgatgtaacgcgcttttggtcccatatctctgtgcgtcagtttgaaccaggcacgagcaaaggcttcattaaaggcctgtggatcgttaaggaaacgacgggaaatcttctcgaactccggatcaaaacgcagcgtcaggtcggtgaccagcatggttggcttacgttttttcgacggatcgaacgggtccgggatgatatccggcgcgtctaccgcttcaaactggatagcgccagccggactacgggtttgtacccactcatatttgaacaggttctcgaagaaatagttgctccactgggtcggcgtctgcgtccagaccacttccagcccggaggtaatagcatccgcgccaacgccgctaccatagctgctggcccaacctaagccctgcgcttcaatcggcgcggcttccggatcggcccctacatgggatgctgctgccgcgccgtgggttttaccgagggtatgcccgccagcgatcaacgccacggtctcttcgtcgttcatccccatattgccaaaggtagcgcgaatagcggcggcggcagaaagtggttcgccgctgtgatccggcccctccgggttaacgtagataaggcccatctcggtcgcgcccagcggcgcttttgccagcgcttcagggtgtcggtgagtcaaccaggctttttcatcgccccagttcacatccagatccggttcccagacatcttcacgcccggcgccgaaaccgaaggtacggaagccggagttttccagcgccacgttacccgccagaataaacaggtcggcccaggaaattttctggccatatttctgcttaatcggccacaacaaacgacgcgccttatccaggctgacgttatccggccaggagttaagcggcgcaaaacgctgttgatcacgacccgcgccgccacgaccatcaatagaacggtaggtgccagcgccatgccaggccatacgaataaacaaaccgacatagctgccccagtcggcgggccaccacggttgtgaatcggtcagcagcgccttgagatcccctttcagggcggagtagtctaacttgctaaactctttgcggtagtcaaagtcttcgcccagcgggttagaacggttggaatgttgattcaaaagatccacacgaagctggttcggccaccagtcgcggctggcagtccctgcgcctgcgcttcggtcatgccccccctgatggaaaggacattttccagtggataacgtgttatgggtatcgtcggtcgtgctcatatctcagctcccttttaaagtgttaccgttacgatatacaccaggagcaaatagatatagttgaattaatccacagattcgatagctaataccttttatatttttagttacagagatgtagatcaatatgagttgtaataaagctcccggcagggagctggaggttataaacccggtcttacgcccagcgtgtggcaaatggcataactcatttccgcacgattcaacgtgtagaagtggaaatccttcactccttcgcggcttaaaattttcaccatgtccatcgcaatgttagcgcccaccagcttgcgggtttctgcgtcatcatccagcccctcaaacatcagcgacatccaggacggaatgcggacattggtcatatcggcaaattttttcgcctgtttaaagttagacaccggtaaaatgccgggaataatttctacgtcgataccggcggaaacacagcggtcgcgaaaacgcagatagctttccacatcgaagaaaaattgggttatcgcgcggttagcgccagcatccactttacgcttcagattaagcagatcggcctgcgcgcttttcgcttccggatgtacctccggataggccgctactgaaatatcgaaatcggccacctctttgagcaaaccaaccagatcggcggcgtacatctccggcttaccgctgcccggcggcaaatcgccgcgcaaagcaacaatgtggcggataccgttattccagtagtcgcgggcgatggtgcgcagttcatcgcgcgtggcgtcaatacaggtaaggtgcggcgcggcctcaagcccagtacgctctttaatgcctttaataacactatgagtgcggtcacgttccccggagttggcgccatacgttaccgaaacaaacttcggtttcaggctgctcaggcgatcgatggagttccacagggtttgctccatttcactggtgcgcggcgggaaaaattcaaacgaaacgttaatctgaccctgtacttccgccaggctctgattcagggcttcccgctggttggcgtgaaaaaagctcataccttacctcatcaatcgcatgttattatttgttgtgctgtaaacatctatccgtttagacgtccagatgtaaaaatgacggaaaagcggaaggacgtcaactgaaaaatcacgccaaagaatgaggaatattcagcaaagttgaaaaaacttcattctccatcatcttgagcaataccttcttcatacggttccgggtgttcttcaacacataaaaaataaggcgtaaatgatatgattcaacgactttggcgacgcagggacgggggaaccagaagatgaacacagcgaatttcgagttgatacatatcatgatcgacgcgcaagcgtggcgcaatctaccgctgcatctgcgcctgtaccacgcttttcgccaattggtaatttccggtgcgttggctgatggcgcaaagctaccttccgctcgcgcgctggcccagcggctgcacctttccagggataccgtcgaaaatgcctattcccagcttcagcgcgacggctttatgacccgcaggcaaggggccgggagtttcgccagccgccagggggttccgcatattcaggggcagcacagcctgccgccatcgcctcgccagacgcccacgcttagcgcccgctggcagacgattgccgatcgcgccgtatctttcgatgcccgccgggtgcagacgtttacgctcggccttgcggaaacgcgaaacttcccgcaaaccatttggcagaattttgcccgccagatccagcgcgagcgggcgcatacgctaatgctgcatggcgatccgcagggagagcaggaactgcgccagcaaattgcccattatctcaattttgaacgcggcgcgaaggtcgacgcgcagcagattgtgattgtcagtggcgcgcgtcaggcattctggctatgcgggcaactgctggcagaggccgggcagtcggtggtgatggaaaatccaggctatcccggcgcgcgtcaggcattctctgccgcacagctcaaccttcttcccattgaagtcgatggagacggtattcgggtggataaactgccgcctgcgccgctggtttacgttacgccgtcgcaccagtttccctccggtcatttgctctctctggcgcggcgtcatgccctgattgactgggcacaggcgcataatgcctggattatcgaagatgactacgacagtgaatttcactacaacggcgcgcccgtcgcctgtatgcaggggttagatcgcgagcagcgcaccctgtatgtcggcaccttcagcaaaacgctctaccccggtctgcgcattggttatctggtggtgcctgcgtcgctggccgcgcactttgccgctgcgcgtaatttgcttgatggcgcaacgcccgcgttgacccaattgacgctggcgcgatttatcgcatccggccattttgccgcccatatccgcaccatgcgcagtatgtacgcggtgcggcaggcgtgcctggcgcaggccatcaaccagcatcttagtgattgggtgacgccggtagtgacgcccggaggattacaaatgccctgctggctgcatgaaggtattgacgaacaacagacccttaacgccgcgcggcgggccgggttaaacatcgccgggatgcgccagttctggctgacgcaccccgcgcccacgggctggctgttgggattcgccgcgtttaccccctacgagattgaaaatggagtcaagcttctgcgggctgcattatgcgccgaaaacgtgcgccaagccgggccataatctcataagggatggtatcgcaggcggcagcaacctcttccagcgtctggctcacgccaataaactccacaacatcgccagacgttggcatgatggcgctggcgtccaccataaagctgtccatgcagacccgccccaacaccggcaaccgaaccccgcgccagcacacgcccgccggaggacgcaaattacgcggaatcccatcagcgtatccggcggataccgtggcgatacgcagcgggcgagtggtagtaaccgtactgccgtagccaatcggcgtcccaaccggcacgtcttgcacgcgcaaaatggtcaacgtcagcgtaaatgccggttttaacggcgttgaaaaccacggctgggcgacgccgaacagcgcaacgcccggacggcaaagatcttcccgccaggccggatgcagaaacataccgcaggaatttgccagcgaataacggctggttgggaatgccttttttgcctgctggagtagcgtatgctgatagacatttaacgcatgatccggcctgtcggcgttggccagatggctgatgatatagtctggcgcagcccagccacgctggcgaaaaatcgcggccagccgcgccagttgctccggcgtcacccccagccgcgacataccagagtcaagctggatcaagaccggacgccgctgcgaccgagcctcctgtaacgccagccacgtcatcacctggtcaacggaattcaacaatggtgtgatctgttgtgcgcaacaaaacggcatcgcctgcggcatgacgccattaagcaacaccaccatcgcgtcagccgacaggatgttacgtagcgccaccccttcagaaagttgcgcgacaaaaaagatccggcaattggccgcatacagggctggcgcaatcgcctccgcccccaagccatagccattggctttcagtactgcgccgcattgcgcgggggcgacatggcgcgccagcgtttgataattgtcaacgacagcggcgagatctacacaaagaacgccgcacgccgcctgaatttcagcaagtttcatcattggtaaggcaacggatagttggtggttaatttagtcactttttgccgaatatcggcgcaaatatctgcaatattcggcgtcttgatggcaaaaataatttcactgatccagtccgcgatcagcgtaaaatcatcggccttcatcccgcgggtggcgcaggctgcgctgccaatgcgaatcccggaggtaatcgacggcggctgtggatcgcctagcaacgtgtttttattgaccgtgatccccgccagttcgagaaagtattccacctgagcgccggttaacccctgcgggcgcaggtcgataatgcccagatggcagtcggtaccgcccgttaacagcgtcaggccgcgctgcgccagttgctggcacatcgcttgcgcattttcgattacctgcccggcgtaacgtttaaattcaggctgtagcgcttcgccaagcgccaccgctttagccgcgataacgtgcatcaacggcccgccctgcaagccgggaaagatggcgctgtcgatttttttcgccagccgggcgtcgttggtcagaatcatgccgccacgcggcccgcgcaacgttttatgcgtggtggcggtaatcacatcggcatacgccagcggcgaggggaaacagccgcccgccaccagcccggcaaaatgcgccatatccaccagcagcatcgcgccgacggcatcggcaatgcggcgaaagcgggcaaaatcatagtgtcgtgggtaggccgatcccccggcgataatcagccgcgggcgctcacgcttcgcgatcgtctcaacctcatccatatcaataagaccgctatgcgcatcgacgccatagtgaaaggcgttaaaccatttgccggattgattgaccggcgagccgtgagtgagatggccgccgcattgcaggctcatgcccagaattttgtcgccgggtttcagcagcgccagatataccgcctgattcgcctggctgccggagtgaggctgcacgttaacataacgcgcgccgaaaagttgctgcgcgcgggttatcgccagcatctcaacctcatcaatgaacttacagccgccgtagtagcggtgctggtaatagccttcggcgtatttattggttaacaccgacccttgtgccgcaagaacggcagggctggcgaaattctccgaggcaatcagttccagcgagtgctgctggcgctgttgctctttattaagtaaatcaaaaagcggatcgttgtttatcatgcggttcccccgaaaattcatcatatgatgattttcgcagggaaagtttcccccgcaccccgccactttttacgcaggacgcagaccaccggatagaggggtaaatttcggcaggaacatgccgggaacgcggcgcgtaacccggcaaaattacagaagctacgccagacggttgatatccgcggtccacgaatgatccaggccagacataccgccgtccggcctgaatgcgctaaaggccattgcgcacaggcaagtaaccccttacttcttcacatccgcaacacgcattcctttgagctgctcatccgtgatggtgttgcccgccttaaagtaatcaactatcgcattcgacacatagtagccgccggaggtgttccgtgcctggccttccgtgaacgccgcaaaaccatcgccgccgtcggcaaggaagctgttggtagcgatgtgataaaccgccgcatcatcaatcggcttgccattgagcgtcagcacggtaacccgctggccgataggtttgctgctgtcatacttcatctccagccctttagacacctgcaacacgccgttgcttaatccggcgccatgctccatcaggctgcgcaattgtttaccggttaaatccatcgtgaccagttcattagggaacgggaaggtactgattaccgcccccatcgtcaccgcaccagccgggatttcgttgcggataccgccagagttagtaagcgctaactgggtgtctttccccgccgtaaaaagcagcgcatccgccgccagattccccagcgacgacgattcgccatacgcgcgggtcagctcaaccggcgactgcgccaccgtttgctgcacgactttatcgagctttttgttccagccgtcgatcacctgtttcgtttgcggatcgggcttccactcatcagcaaaaatggtcttcagctcgaagttcttcacggtaaactgatgcggcttttcctggtagtccagcaccagtttgccgacatcaataccgccgctgtccgttgagaggatcagcgtattaccgactttaatcggttccggcgtaccgacatgcgcgtggccggtaatcaaaatatccagcccttttacctgacttgcggtctgaatatctttatccagcgcgcgtcgcacatcggtattccccatgctggactggcgggccggggtgccttcgtggatcagcgcgacggtcagatcgactttacctttaagttcatcaatgtaacgttgcagccacttaatttcatcgcgagcctcaatgcccacgcgcgtcgcggcagaaaccgtatcattaaaagcaaagacaccgtgtaagccgattacgccaatcttgacgccatctttttcaacaatggtgtacggcttatcccagaaggatttactgctgtcctcataaaaaatattgccctgtacgatagggaatttcgcccggctcagttgcaacaatgtattgtcccagccatgatcgaactcatgattaccgatagtggcagcgtcatactgcatggtattcaaaatatcgataatcgctttacccttcgtcaggctgctgatatacggtccggtaaagtaatctccggcatcaaaaaaccacgtcgccttatttttggctttttcctgcttcaccagcgtagtgatattggcccaaccgccaatatcgcgtttaccgtcagcaatccacggtactttataaggctccacatgggcgtgtagatcgttggtgtaaataatggtgacatctttggcgcaggcccagaacggcagcgtgaacaaaataccggcagcaagcagttttactttcataaataagtccctttcagtcatataaagattcgctacgttacgttctgaaaggtttttttatgtgagagtcctcacatccgcgtaccgttttatgaaggcagaatcaacgacctgccaaaatcgttggtaaaatgtatgccgcctctgttcaccattaatgcctgcaaaagcgctggttgtcgcaatcttgggctgcctgactcgccggattatgtgtggccggactatcgcctgggttatccggcattgcattgtcgggcctgcggcagttatccaccgctcttcaacgagggggaatttcgccgctgggcgtctgcttacatcgcgcaatatgccaaagagcatggtcacttttgccccgattgctatcaaagaacatggattcgttatggacgtaatcccggcggaacgcagcgacttcagtgccagtactgtaagaaggtctggacgccaaaacagcacgcgctgaatgtcgccgaaacgccggaacagatttgcagtattccgctgctcgtaccgtttcagggagcgaatgccttccaacaattgtactttttattcagttttgatgctgttcgcggcaatatacttcacctttccagcaatttcacgttactttctgccggaaagagtttgcattaccactggaaaggaattgcgccgcccgagggcgagaagggcgatattattcaccgtatcgccattaaagaacggcaatttttacagcgcagccagttcgatgagattcagtatggcccggcggcgcttaaacgtaacgcgcaaggaacaatacttcgcccggtgattacggcgcatggtcattttcgggtgctgaaaaaccgctttcctgatgtcgcgacacacatcattgcccatgagtgttttttgcgcggcgcggtcattacggcatgggcggagcggtttcgccagcgtctctcctcgctgtggttcgttgaggaagagataaacgatgacgattgccgcgcagagtggcaactgttaggcaaaacatggcagggatggtggcaaaatcagtggcaactctgggggcaaggtcacaaccgcaaaatggtctgttcgttaaccggttcccacttagaacaaggtgtcgccgttaatctggcggccagtcgccgctttgttacctggctatggcaacaacctgaatttcagcaaagcgcccactgttccgccaaacgcgtcacacaaattctgtatttgctgacggaaaaatataactcacaatggaatcacatttaactcaatgatgtaatgccacgcataaaaaatcacagattatcattcagaaggcgctatagatttaatcacctcacatcctgcttttacacgctgaaaaagaatagagctatttgataaatggcccttcgttttgcgttaagatcggctataaacgttattcacataatcaatatttattatcaatttgaatagctctatacattcttattttctatggaaaacaagggataaatatggaaattactttaccgtcaatgtcagataaaaaatggacctgcgccgatctcctgagtagctaccgattctgggggatcacttttttctttttggcgctctcttttatcagttcgctgggatcgtcgtatggtgtttatttttggagtaaatcactgtctattccagccgatcgtattggtcttattctcgttggcgtaaatggcccatctgacgtagtcaggcttatcatagcacagcaatattgtgtctgacgcttagcgacgaaatccaaacattgcgggcgaatgcaaacgaaaatacaggtatacagagcggctggacgctattttgggcattgctgttcccccctgtcggcatagccattatccaggcgaagatgaaccgatttatcgtcgccaatgcagaaaacgcatctgacgaagaataaacagataccccggtttgcccgctgccggatctggcgaagccgctatccggcaggcgggcgtattacaatagctgcgccaggcggttgatatccgactgaatcgccccggcggtcacatcgcgacccgcgcccggcccacggatcaccagcgggttatcgcgataccagcggctttcaatagcaaagacattatcgcacggcagcagcgccgccagcggatgctccggacgcaccgcttcaacgccgacgcgcgctttgccattggcgtcgaaacgcgccacgtaacgcaacaccagccccagttcgcgggctgcctccagacgctgcaccatctgttcattcagcgcgtcgccgttttcgaaaaagtgatcgatagacccttcttcacagtgcgccggcaccaacgattctacacgcacctgatccggctcgatgtcgtatcccgcctcgcgcgccagaatcaccagcttacgcatgacatcttttccggaaagatcgacgcgcggatcgggttccgtcagcccctgctgccaggcctgatccaccagatcggtaaacggcaccgtgccgtcaaattgcaggaacagccaggatagcgtcccggagaagatcccgctgatcgagagaatcgtatcgccgctgtcaatcagatcccgcaccgtgtggttgatcggcaaccccgcgcccacggtggcgttatacagccagtaacgcccggttttttcaaacgcgtcatgaatctggcgatacttatcgctggcgcttgcgcccgccagtttattggcgctaatcacatgaaaaccgtggctggcgaaatcaaggtactgatcggccagttgctcgcttgctgtcacatccagcaccactaaatcatcatacggatgcgcacgcatccacaggaatagcgactcttcgtcctgctcaacggcttcatcatcaaagaatgccagcgcgcggctggcgtccagcccttcataattcaacaggctacggcggctatccaccacgcccgccagcacaaattcaaaaccagtacgcgcggaaagcgtgctttgttcacgggcaaatagttccagccaacgggagccgatgttccccttaccgaacagcatcaggccaatgcgtttttcggcgcggaaaacagactggtgcagcccctgaatcaggctctcagtcgggccggtacgcagcaccgccaccagactgatgccctcctccgactgccaggtaaactccactggctgacctttcaactgctgccagaagcgatggcagtgtagcggattgcgagtgacgcccgcaccgaccatcgccaccagcgccagcccctgccgcaggcgcaattcgcccggcagtccgacatcgtcgaggagtttcagtacgctatccgctacctcggcggtatagcagaactgcaatagctggcgatcgcgatgcacgcccaccgccagcggacgcgcctgcgcccgttttaaaatttggtcgagctctttgtgcgccagcctgaaatcctggctggcgggcacctgaaactcaatcagacagatatcatcgtgactggtcacgatacgcgcgcccgtcccggaagccagcactcgttcaattcgggttgacccttgatccggcgtgtagctacagcgcaactgcaaatcgatatcgctgccggacactggctgtagcgtgcgggcgtgcagaacaggcgccgccagacgcgccagctcgctggcttcgtccagacgcagcaacggcagcaggcaggcatctttcactttgcgcgggtcggcgctataaacgcccgcgacatcgctccagatggtcacgcgggaaacgcccgccaacgcgccgatttgcgtggcggaatagtcggaaccgttacggcctaacaggactgtttcgccgtcgtgattgcggctgataaacccggtcacgaccagacgtttgccaggatgctgcgccagtagctgttgcaataaaggataagatagtccttcatcaacctgcggctgtgcggcgcgttcggcgcgtaaaaatgcgcgcgcgtccagccaggcggcatccagcccctgctgattcaggacggcggacatcaatctcgccgaccaaatttcgccgtgtccgacgatctcagcatagacggcatccgttacgccgccgtcgagcaaggcggcaagacgttccagatcgctgataaaagcgctggttaagtcatctgccgcgtcggcgggaagcagcccgctaatcagatcgcactggtagcggcgtaacgtctgtaatacctgatgcgcagaaaggcgatcggtctggcttaacttgagccagctaatcaactggttggtggtactgcctgcggcggacactaccatcatatcgtcaggctgcgaatactccgccataatgcctgcgacacgcaggtaacacttcacatccgccagactactgccgccaaatttatgcagttgacgacctttcgcccctgcctgcgcaatcacactcatgtttaccccttgtttgcagcccggaagccattttccaggtcggcaattaaatcttcgccatcttcaataccggtggagatacgcagtagcgtttcggagatcccggcggcggcacgcgcctgcggcgacataccggcatgcgtcatggtggcggcgtgagagatcaaactttccactccccctaaagattccgccagcgtaaacagcgacagcccgcccagaaaacgacgtagcgtctcctcatccccatccagttcaaaactcaacattgcgccaaagcctttttgctgacgcgcggcaatctcatgtccctgattattcggcagcgacgggtgatacagttttttcaccaacggctgggtttgcagatatttcacaatcgcctgcgcgttgcgctgcgccagctccatacgcggcaccagagttcgcaaaccgcgcagcagcagatagctatcaaacgccccgccggtcacgccaatattattcgcccaccacgccagttcagtgaccatttccggatccttagcaatcatcacgccggccacgacatccgaatgaccattgagatatttcgtgcatgaatgcaacaccagatcggcacccaacgccagcggattttgcagcgccgggcttaaaaatgtgttatcaacgacgctcactgcgcccgcctcgcgcgccagccgacagattttcgcaatatccaccacgcgtaacaatggattacttggactttctaccagtaccagcttcggtttttcttccagcgccgcctgtaaggcgcgttcatcgccctgatcgacaaaccgcacacgataacagccgcgcgtcgccagactgtcaaacagacgataactgccgccgtagcaatcatgcggcgcgaccagcagatcgcccggcttgaggaaaacggtggtgaccagatgaatcgccgacatgccggtattcgtcaatactgcgcccgcgccgccttccagttccgctaatgcgcgctgaaccacatcacgcgtgggattaccgcggcgggaataatcatgcgcgcgcggctcattgaaaccggtaaagttataggtactggagagatggattggcggcacaacgcagccgtattgttcgtcatcgtttaatccgctacgcactgcgatagtggcctgtttacgcgtcatatgaagatattcctggctgagtcggtgaaagtcaggccacagattaaccactaccacaatagacgtcaatacatctggacatctaaacttctttgcgtatagattgagcaaaccgcaaatagccgttaaaattatatgcattagcgcacatctgcgaccgctaacttcgtgtcagggccgcgccactacggtaaactacgcgcgattatggtccgggctcaggttcagacctcaatattaatgacgaagaggattaagtatctcatggctgaatggagcggcgaatatatcagcccatacgctgagcacggtaagaagagtgagcaagtcaaaaaaattacggtttccattcctctgaaggtgttaaaaatcctcaccgatgaacgtacgcgtcgtcaggtgaacaacctgcgccacgccaccaacagcgagctgttgtgtgaagcatttctgcacgcctttaccgggcaacccttgccggatgatgccgatctgcgaaaagagcgcagcgatgaaatcccggaagcggcaaaagagatcatgcgtgagatggggattgacccggaaacgtgggaatactgatagcaaagcatgcggtcagaacgcctctggccgcgcttttttaacgatttcccctgtacacggctatctccgacattgttctaaacgttcatcttcccgaatagccctcggtggataaatttgtcagacatgataagtttctcttcgttattttcctgaaaaaattcccggcatgccataatcgatataattttattatatttaaaattccaatatttatttaatgtttcacgtagcaaagcgtacatgaataataatacaccgccatatatttactgaataaatagtataacgatgattattgttaaaaagaccatgaacacctcatatttgtgaccaacatcattattcccctccgcggattgttttacttttttaaatgttttttcatctccgataaataagaaggttaatatacattcattttatcgataatatcgaatggggaaataaatatgttatttacaaggaaagtcttacctgtattatgctgcctgtgtttgagcggcagcgttttggcctcaggcgttttagacccaaacaggccaatggtcgcatcagcagatgtcattccagtacatgaagggccattaggtatggtcgatgtcgccccctacggcggcgttttcccattaacagcaatcattaataaagccaatcataatgtacagaacgtgaaggttaccgttttagggaaaggggaaaaaggtatccctatcagttatgatgtcggcccgcaggctataaatacccatgacggcatacctgtatttggcttgtatccagattatgtcaataaggttaaagttgactggactgaagaaggtaaaaaacaaacttatacgtggtccatttacgccgcatcggtatcattaccctctactaccgggcaaactgccgttcttcctacggtagaaccggttaaagtcgatagctcgcttaaaaatcgcttatatctttttaaccatataacggggatgccaagggcaggccacattatgcatgtcgcaggcggcgcggcgaactgggattataccggtatcaactggattagcgatacgaatggcgatgttcgcggctatatgaatattgataaattccgtaaccaggatgatataacgcgctttggttccatgatgggcttccatcaggttaacgatggcaatcttatttttggccagggtcaacgttactttaaatatgatttcttaggccgcgttatttccgataaacgactgccaaaaggatttattgatttttcgcacgccattaccgaaacgccgaaaggcacctacctgctgcgtgtcgcaaaagaaaattatccattaaatggtaaatacaccatcaatactgtgcgtgatcatattcttgaagttgaccagaacggcgataccgtcgattactgggatctgccaaaaatcctcgacccctatcgtgacgatgttattctggcgatggatcagggagcggtatgtttgagcgtcgatgccgaacattccggtcaggtcatgaccaaagagcagcttgcaaaacaacccttcggcgatatcgcgggctccggcccgggccgcaactgggcgcatgttaactccgtcagctacgatcctcgcgacgacagcattatcattagctcgcgccaccagtctgccatcatcaaaattggccgcgataaaaaagtgaaatggatactttccgatccatccggctggaaaggcgaactggcgaaaaaagtgctgaaacccgtagacagcaacggtaaaccgctaacctgcgaagcgcaccactgcgacggtggatttgactggacatggacacaacataccggttggttagtgccatccaaaagcaccggaggtaaaaccgtcgtgaccgcctttgataacggcgatgcgcgcggcatggaacaaccggccatgccgtcaatgaaatattcccgcggcgtggaatatcagattgacgaaaaaatatgacggtttcccaaatgtgggaatatggtaaagagcgcggttttgactggtacagcgccattacttccgtcacggaatatcgcccggaaaccaaaacgatgttcatgtactcggccacagcgggaatgagcggtacaaatccaatcgtttccgttctggatgaagtcaaagacggtactcaggatgtgatgctggagctaaaagtacacagtaaccgtgctggtatgctgggttatcgggcgctgattatcgatccagagcagatgtttaaaaaataaagcgtgagagtaaaagtaaaacaggcggaagccaacttccgcctgaatggttaaaacgtattgtagttatgacattcgccttattgccctcggagaggaatgcaaaaatatcaatgaattaccaatccggcaccgacccgataagcgcagcgtcattagacaaacgccacaacataccgcgcctttgctggtgatatgtcatgaaaaatctctttatcgcctggttaagtttattgctatatggctgcacaacctttccacaagccgtaaaacctacgacaggcggacagccctccccgacggaaatctatatcgtcagtcatggctggcacacgggaattattgcgccggcccatgatgttaataccgttctgccacagcttaaaaaacggttcgctcaggagacgcagtggtatgaaatcggctggggcgataagggcttttatcagtcacaagaaataaccaccgcgcttacgctccaggccatgttctggtcatccggcgcggttatgcacatcgtcgccttttccggtcaaccagaacgctatttcgccggtagcgagataaaatcactgctcctgcacacaaaccagcgtaacagtctgatgcgttatctgggccgcagctttgcgcgtgacgcagagggtaatctgattccgttaaaacaaggaatttacggcgatagccagttttacgccgcgaatggccgctacggcatactcaatacctgcaataaatggacagcgaaggggctggaaagcgcgggactgactataaatccttcgttaaaactcacggcaggaagcgtaatgaaagcgattacggatcacagaatgtgtctgaacaaatactgttatccctagaaaacaaaaaaagcgccctgcggcgcttttttttctggcggtaacttatttgctgccagggatgctgaagcgcttgttgaagcgctcaacacgaccaccggtatcaacaacacgctgcttaccagtgaagaacgggtggcatttgccgcacacgtccaggttcaggtcgtgacccacggtagagtgggttttgataacattaccgcaagaacaggttgcagtaatttctacgtaattcgggtgaataccttttttcatggggaacctcagtgtaaggccgcgtcgctcttccagccctaacgccagacaccacgcgaagttaatagtaaagggtttgatgctcacaacacgcaccaaaggcggcgaatcatacagaatttgaccaccgtatgcaaactgatccgcgctcccttatcgtaatgtgtatactacccgacgaaatttcaagtcaggaagatgctatgtccgtcgcgcacgttgccttgcccgttccgcttccccgaacctttgattacctgctgccggaaggcggggtcgccaaagccgggtgccgcgtgcgcgtgccgttcggcaagcagcaagagcgcgtgggcattgtcgtctcggttagcgaccacagcgaattgccgctcgatgaattaaaatcggtcattgaaatcctggataacgagccaatcttttctccctccatctggcgcttactcctctgggcggcggattactaccaccatcccctcggcgacgttctgtttcacgctctgccggttttactgcgtcagggaaaaccagccagcaacgcgcccctatggtattggttcgccaccgaagaggggcaagccgtcgacatcaacagcctgaaacgctccgccaaacaacaacaggcgctggcggcgctgcggcaaggaaagatctggcgctatcaggtagccgagcttgattttactgacgccacgctgcaaacgctgcggcgtaaggggctttgtgagcttgccagtgaaacgcccgcgtttaccgactggcgggagcattatgccgtcgcaggagagcgcctgcggctaaataccgaacaggcgacagcagtcggcgcaattcacagcgcgtcggacggtttctccgcctggttgctggcaggcgtaatcggttccggcaagaccgaagtgtatctgagcgtgctggaaaacgtcctcgcccagggcaaacaggcgctggtgatggtgccggaaatcggcctgacgccgcaaacgatcgcccgttttcgcgaacgttttaacacgccggtggaagtgctgcattccgggctaaacgacagcgagcgtctttcggcatggctgaaagcgaaaaacggcgaagcggcgattgtcatcggcacgcgctcctcgctgtttacgccgtttaaaaatcttggcgtaattgtcatcgacgaagagcacgacagctcttataaacagcaggaagggtggcgctaccatgcccgcgatttggcagtgtatcgcgcccatagcgagcagatcccgattattctcggctccgccaccccagccctggaaacgctatgcaacgtgcggcagaaaaaataccggatgctgcgtctgacgcggcgcgcaggcaacgcccgcccagccctgcagcatgtgctggatttaaaaggacagcgtcttcaggcgggactggcgcccgcccttatcgcccgtatgcgccaacatctccaggccgataatcaggtaattttatttcttaaccgccggggattcgcgcccgcgctgctttgccacgactgcggctggattgcggagtgcccgcgttgcgatcactactacacgctgcaccaggcgcagcatcatttacgctgccatcactgcgacagccagcgtccggtaccgcgtcagtgcccctcctgcggctccacacatatgctaccggttgggttagggaccgaacagctggagcaggtgctggcgcccttcttccccggcgtgccgatctcacgaatcgaccgtgataccaccagtcgtaaaggcgcgctggagcagcatctggcggaagttcaccgcggcggagcgcgcattctgataggcacacaaatgctggcgaaaggccatcacttcccggacgtcacgctggtggcgttgctggatgtcgatggcgcgcttttttccgcagattttcgttcggcggaacgcttcgcccagctctacactcaggtttccggccgcgccgggcgcgcgggtaaacagggcgaagtggtgctccaaacgcaccatcctgagcatcccctgctgcaaacgttactgtataaaggctatgatgcgtttgcggaacaggcgctggcggaacggcaaacgctccagcttccgccgtggaccagccacgtcattattcgcgcagaggatcacaacaatcagcaggcgcccgtctttctccagcagttgcgtaatgtgattcaggccagcccgctatcagacgataagctgtggatcttaggtccggttccggccctcgcgccaaaacgcggcggccgctatcgctggcaaattttacttcagcatccttcacggattctcctgcaacacatcatcagcggcacgctggcgttgatcaatacgctccctgaagcgcggaaagttaaatgggttctggacgtcgatccgattgaaggatagtccccacgatgcgaggcggatcgtaaaattaaagatccatcacactttttatgaaaattctgtaaccgcttccacgcactatctgataaaaatgttttcgatgagtgttaccagggatagatctgcgccagcagttcccaggcgaggagaaagagtgaaatcgaacaagcaagttactgccgctacgatgaaggatgttgcgttgaaggcgaaagtctctacggcaaccgtatcccgcgcgttaatgaaccccgataaagtctcccagtcgacccgtagccgggttgaacaggccgcgcttgaagtgggttatttcccgcagtcgatggggcgaaatgtaaaacgcaatgaatcccgtacgattttggtgattgtcccggatatttgcgatcccttcttcagtgaaattatccgcggtatcgaagtgaccgcggcagaacaggggtatctggtgctgattggcgattgtgcccatcaaaaccagaaagaaaaaacctttcttaatctcatcatcaccaaacagatcgacggcatggtactgctcagttcccgactgccctttgacgccagcgttgaggagcagcgcaatttgcctccgatggtgatgtcgaatgagtttgcgccggagcttgaattgccgacggtacatatcgataacctgaccgccgcgttcaatgccatgaactacctgttggatttgggccacaagcggattggttgtattgcggggccggaaaatatgccgctctgtcactatcgcttacaaggttacgtacaggcattaagacgcagtggcattgtggtcgatccgcattacatcgcccgtggcgactttacctttgaagccggggcaaacgcattaaagcagttgcttgagcaaccgttgccgcctaccgccgtcttttgtcatagcgacgtaatggcgctgggcgccctctcctgggccaagcgccagggtctgaaagtgcctgacgatctgtcgattatcggctttgacaatatcgcgctggccgagttttgcgaccctccgttgacaaccgtggcgcagccgcgttttgacattggtcgcgaggcgatgctgctgttgctcgatcagatgcaggggcaaaatgtgagcagcggctcgcgtttaatggattgcgagctgattattcgcggttctacacgcgctttaccctaaagtaaatagctttaagactcacctgtctggtcaaaggcccgccgcttcagtaacatgacgggctgacgaacgaataaatacagcgaaacgatagtggcacaacgagattatgtacgtcgcggccaaccggctccttcgcggcgcaaaaagagcacctcacggaactcacggaagaagcaaagcaacatgcctgccgtctcgccggcaatggtcgcgattgcggcagccgtccttgtgacctttatcggcggtctgtacttcattactcaccataagaaagaagagtccgaaacgctacaaaaccagaaagtcaccggcaatgggcttccgccaaaaccggaagagcgctggcgttacatcaaagagctggaaagtcgccagccgggcgtgcgtacgccaacggaaccgtccgccggcggcgaagtcatgaatccgaatcagctcaccagcgagcagcgtcaactcctggagcagatgcaggcggatatgcgtcagcagccgacacaacttaacgaagtgccgtggaacgagcagacgccagaacaacgccagcaaacgctacagcgccagcgtcaggcgcagcagcagcagcagcagcagcagcagcagcagtgggctcaaacgcagcctgttcagcaaccacgcacgcagccgcgggtaaacgaacagccgcaaacgcgcacggtacagtccgccccggcgcaacccgcgcgccaaagtcagccgccgaagcagacggcctcgcagcaaccttatcaggatttgctgcaaacgccggcgcataccagcgcggcagcgccaaaagccgcgcccattacgcgcgcgcctgaagcgccgaaggcgacagcagagaaaaaagatgaacgtcgctgaatggtgcaatgtggttcattcaaaggcgccgagcaggcagaaagcgtccgcgctcagctggcgtttgaaggctttgactccaaaattaccaccaataacggctggaatcgcgtggttatcgggccggtgaaaggtaaagaaaatgccgacagcaccattaaccgtctgaagatggcgggccatacaaactgcattcgactcgccaccgggggttgaaaccctcaaaatctcccccatctatacttgcattatgccccgtacgccgtacggggccgcaattcagcattagtaaccaaggggtctgctcgtgacaacaatagtaagcgtacgccgtaacggccacgtggtaatcgccggtgatggtcaggccacactgggtaacacagtaatgaaaggcaacgtgaagaaagtccgccgcctctacaacgacaaggtcattgcgggctttgcgggcggtactgctgatgcattcacgctgttcgagctgtttgaacgtaaactggaaatgcatcaggggcacctggtcaaagccgccgttgaactggcgaaagactggcgtaccgaccgtatgctacgcaaactggaagcgttgctggccgtcgcggatgaaaccgcttcgctcatcatcacgggtaacggcgatgtcgtgcaacctgaaaacgatttaattgctatcggctccggcggtccttatgcccaggctgccgctcgcgctctgttggaaaataccgagctcggcgcgcgcgaaattgctgaaaaggcgttggatattgcaggcgatatctgcatttacaccaaccatttccacaccattgaagaattgaccgccaaagcgtaaggacctctcatgtctgaaatgaccccacgcgaaattgtcagcgaactgaacaaacacattatcggccaggataacgcaaagcgttccgtggcgattgcattgcgtaaccgctggcgtcgtatgcagcttgatgaagagctgcgccacgaagtaacgccgaaaaatattctgatgattggcccgaccggcgtcggtaaaaccgaaatcgcccgtcgtctggcaaaactcgccaacgcgccgttcattaaagtcgaagccaccaaattcaccgaagtgggctatgtcgggaaagaagtggactctatcatccgcgatctgaccgatgccgctgtgaaaatggttcgcgtacaggctatcgagaaaaaccgctatcgtgcggaagagttggcggaagagcgtattctcgacgtactgatcccacccgcaaaaaataactggggccaggccgaacagcagcaggagccttctgccgcccgtcaaacgttccgcaaaaaactgcgcgaaggccagctcgacgataaagagatcgagattaacctcgccgccgcgccgatgggcgtagagattatggcgcctccgggcatggaggagatgaccagccagttgcagtctatattccagaacctaggcggtcagaaacagaaaccgcgtaagctgaaaattaaagacgcgatgaaactgttggttgaagaagaagctgctaagctggtcaacccggaagagctgaaacaggacgctatcgacgcggttgaacagcacggcatcgtgtttatcgatgaaattgacaaaatttgtaagcgtggcgaaacctccggcccggatgtttcacgcgaaggcgtacagcgcgacttactgccgctggtagaaggctgcacggtttcgaccaaacacgggatggtcaaaacggatcatattctgtttatcgcctctggcgcgttccaggtggcgaagccgtctgatctgatcccggaactgcagggccgtctgccgattcgcgttgaacttcaggcgctgaccaccagcgatttcgaacgcattttgaccgagccaaacgcctccgtcactgtgcagtataaagcgctgatggcaactgaaggcgtcaatatcgagttcaccgattccggtattaaacgtattgccgaagccgcctggcaggttaacgaaaccaccgaaaacatcggcgcgcgccgtctgcataccgtactggagcgtctgatggaagaaatttcctataacgccagcgatttgcacggccaaaacatcacaattgatgcggaatatgtgagcaaacatctggatgcgctggtcgcagatgaagatctaagccgttttatcttataatcgcgtccaatgcattttcatcactgttgatggggctgaaaagccccatttttattggcgctaaatatgactgaacaacaacaaattagccgcacccaggcctggctggaaagcttacgacccaaaaccttacctctcgccttcgcggcgattatcgtcggtacggccctggcatggtggcaaggctatttcgatcctctggtcgcactgctggcccttatcaccgccgggctgttgcaaattttatccaacctcgccaacgattacggcgacgctgtcaaaggcagtgataaaccggatcgcatcggaccgctgcgggggatgcaaaaaggcgtcatcacccagcaggagatgaagcgggcgttaatcattaccgtcgtgctgatctgtatctccggactggcgctggtggcggtcgcgtgccatacgttaaccgattttgtcggcttcctgattttgggcgggctgtcgattatcgccgccatcacctacaccgtgggtaatcggccctacggttatatcgggctgggtgatatctctgtcctggtattctttggctggctaagtgtcatggggagctggtatctccaggcgcatacgctgattccggcgctgattctcccggccaccgcctgcggtttactggcgacggcggtgctgaatattaataacctgcgcgatattaatagcgacagagagaacggcaaaaacacccttgtggtacgacttggcgatgtcaacgcgcgtcgttatcacgcctgcctgttgctaggcgcgctgctctgtctggcgctgtttaatctgctctcgctacacagtccgtggggatggttgtttattctggccgcgcccttgctcattaaacaagcgcgctacgtaatgcgcgaaagggagcctgcggcaatgcgcccgatgcttgaacgtaccgttaaaggcgcgttgttaaccaacctgttatttgtgattgggatactcttaagtcagtgggccgtttaactgacaaatatcaattaacaattgatgattttgccaacagtatacttagcgcgatatactaaaaattctcgcagcaactgaacgttaagcctatgaaatacgatacttccgagctttgtgacatctatcaggaagatgtcaacgtcgtggaaccgctgttctctaattttggagggcggtcgtcgtttggcggacaaatcatcacggtaaaatgtttcgaggacaacgggttgctgtacgatctgctcgaacaaaatggccgtggtcgggttctgctggtcgatggcggcggttctgtccgtcgtgcattagttgatgcggagctggcgcgtctggccacgcaaaatgaatgggaagggctggttatctatggcgcggtgcgtcaggtggacgatctggaagagctggatatcggcattcaggcgatcgccgccattccggttggcgccgcaggtgaaggcattggggaaagcgatgtgcgcgtcaatttcggcggcgtgacgttcttctccggcgatcatctctatgccgacaacaccgggattatcctttccgaagacccgcttgatatcgagtgatcaaaaaaggcgccgtaaggcgccttttttatgcgttgtcgctgattgccggatgtcggcttacgccttatccggcccaccggtatccgcattctaaatcctctatagatttcgcgtcagggcaaggcggcaagaaagtgaatccccaggagcataggccactatgtgactggggtgaacgcacgcagccaacgccgccataacgtgaaatatgacgaggattagacttcttccatacgaccaagcagcgcctgtaaacgttcctgccagccgctctgctgttccttcagaaaattattttcacgctcgagttcttcacgctgatgctgtgcagactgcacttcctgcgtcaggctgttgttcttttctttcagctcttcaatttccatctgtaacagggtgatggtgtcaatcgcctgctgtacttttgcttccagtttctcaaacacttctaaagacatgatcttacctctcctgaattgcaaggcgacgcttcacgtaaacgcgcacaatatatagtatcgattgtatgaagccccgctctcgctgtccagcgacataccgcgtagatcgcggtttgcagcaattttcatccatctcctggtaacattcattcaataacttaaaagtgttaacatattggttaatgaaatgattcaattcactctcttctgctgtctcaaaatgcgcctcatggcgcgataacgctcattttattgacgcagtacacacattttgatttcgatatttctcgtttttgctcgttagcgataaattaacagtgtgcctacagggcatcgtggatgtccatgacctcctcgcataccaataatcattacatactcttcaggatccgattatgagtcaaacatcaaccttaaaaggccagtgcattgctgaattcctcggtaccgggttgttgatttttttcggggtgggttgtgtcgctgcgcttaaagttgccggagctacttttggacagtgggaaatcagcgtcatctggggtctgggagtagcgatggctatctacctgacggcaggtgtttctggcgcacacctgaacccggcagtgaccatcgcactctggctatttgcctgtttcgacaaacgtaaagttgttccttttattatttctcaagttgccggcgccttttgcgcagcggcgttagtttacgggctttattacaatctttttgtggacttcgaacaaacccaccatatcgtccgtggcagcgttgaaagtctcgatctcgcaggcattttctcaacttacccgaatcctcatatcaattttgtgcaggccttcgcggttgaaatggtgattaccgctattctgatggggctgattctggcgctgaccgacgacggtaacggcgtacctcgcggtccgcttgcgccactgctcattggtttactgatcgccgttatcggtgcctctatggggccgttgaccgggtttgcgatgaatccggcgcgtgactttggccccaaaatgttcgccgggcttgccggctggggtgaaattgcgtttaccggcggtagagacattccttacttcctggtgccactgtttggccccatcgtcggcgccattctgggcgcgtttgcttatcgcaaatttattggccgtcatttgccgtgcgatatctgcgtcgtggaagagaaggactccaccgcggccacacaacaaaatgcttcgctgtaatctgattacgggacaaaattatgactgaaaaatatatcgttgcgctcgaccagggtaccaccagctcccgcgcggtcgttatggatcatgacgcgaatatcgtcagcgtatcacagcgtgaatttgagcaaatttatcctaagccaggctgggtagaacacgacccgatggaaatttgggcgtctcaaagctcaacgctggtagaagtgctggctaaggccgatatcagttccgatcagattgccgctatcggtatcaccaaccaacgtgaaaccgcgatcgtctgggaacgtgaaaccggcaaaccgatatacaacgctattgtctggcagtgccgtcgtaccgccaatatttgcgaacagcttaaacgcgacggcctggaagattacatccgcgacaataccggtctggtcgtcgacccgtacttctctggcactaaagtgaaatggatccttgaccatgtggaaggttcgcgcgaacgcgcgaagcgtggcgagctgctgttcggtacggtggatacctggcttatctggaagatgacgcagggccgcgtccacgttacggattacaccaacgcctcacgaaccatgctgttcaacatccatgatttggactgggacgataaaatgctggacgtgctggatatcccacgcgcgatgctgccccaggtacgtaaatcctccgaagtctacggccagaccaatattggcggtaaaggcggtacacgtattcctatcgccgggattgccggggatcagcaggccgcgctcttcggccaactgtgcgtaaaggaaggaatggcaaagaacacctacggcaccggctgctttatgctgatgaacaccggcgagaaagcggtaaaatcggaaaacggcctgctgaccaccatcgcctgcggcccaagcggcgaagtcaactatgcgctggaaggtgcggtgtttatggcgggagcgtccattcaatggctgcgtgatgaaatgaagctcatcagcgacgcattcgactccgaatatttcgccacgaaagtgaaagataccaacggtgtctacgtggttccggccttcaccggtctgggcgcgccgtactgggatccgtatgcccgcggcgccatttttggcctgacccgcggcgtgaactctaatcacattatccgcgcgacgctcgaatccatcgcttaccagacccgcgacgtactggaagcgatgcaggccgactccggtatccgcctgcacgctctgcgtgtggacggcggcgcagtggccaacaacttcctgatgcagttccagtcagatattctcggcacgcgggtggaacgcccggaagtgcgcgaagtgaccgcgctgggcgccgcctatctggctggcctggccgtcggttactggcagaacctggacgagctgcaggaaaaagccgtcattgagcgagaattccgccccggcattgaaaccaccgagcgtaactaccgttacagcggctggaagaaagcggttaaacgcgcaatggcgtgggaagagcacgacaagtaaggtcgccatccggcaaaatctttgtgcggaggcaactccgcacacacatcaattattccctccctcccctgtgctacactgcgcgccactcctttttgctacgagtttgttatgagacgagaacttgccatcgaattttcccgtgtgaccgaagcggcggcgctggctggctacaaatggctgggacgcggcgataaaaataccgcggacggcgcggcggtcaacgccatgcgtatcatgctcaaccaggtcaacattgacggcaccatcgtgattggcgaaggcgaaatcgacgaggccccgatgctctatatcggcgagaaagtcggtaccggccacggcgatgcggtagatatcgccgtcgatccgattgagggcacgcgcatgacagcgatgggtcaggcgaacgcgctggcggtactggcggtcggcgataaaggctgcttcctgaatgcgcccgatatgtatatggaaaaactgattgtcggtccgggcgccaaaggggcgatcgatctcaatctgccgctggcggataacctgcgcaacatcgcggatgcgctgggtaaaccgcttggcgatctgaccgtgaccattctggcaaaaccgcgtcataacgaggttatcgcagagatggccaaactgggcgtacgcgtgtttgccattcctgacggcgacgtcgcggcctcaattctgacctgtatgccggatagcgaagtcgacgtgctgtacgggattggcggcgcgccagaaggcgtggtatccgcagcggtgatccgcgcgctggacggcgatatgcagggacgtctgctggcgcgccatgacgtgaaaggcgacagcgaagaaaaccgccgcattggcgaacaggaactggcgcgctgcaaagcaatggggattgaagcgggcaaggcgttatgcctgggcgacatggcgcgtagcgataacgttattttctctgcgaccggcatcacgaaaggcgatctgctggaaggaattagccgaaaaggccatatcgccacgacggaaacgctgctgatccgcggcaaatcacgcaccatccgccgcattcagtctatccactatcttgatcgtaaagatcctgatgtgcaggcgcatatcctctagcgcatttgttagttagagccttccagcctcgcggggctggaaatctttctcctgacgaacgaagataaggttagcgattcagaacaggagaaaaccatggccgattgggtaacaggtaaagtcactaaggtgcaaaactggactgacgcactgttcagcctgaccgttcacgcccccattaatccttttactgcaggccaatttaccaaactcggactggagatcgatggcgagcgcgttcagcgcgcgtattcctatgtgaatgcgcctgacaatccgaatttagagttttatctggtgacggttccgcaaggaaagctcagcccgcggctggcggcgctaaaacctggcgatgaggtacaagtggtcagcgacgcgtcgggtttctttgtactggatgaagtgcctgactgcgagacgctatggatgctggcgaccggaaccgctattggcccgtatttgtctattctgcaatatggccaggatgtcacgcgctttaaaaatctggtcttagtccacgccgcacgcttcgccgccgatttaagctatctgccgctaatgctggaactgcaacagcgttatgaaggcaagctgcgcatccaaacggtggtcagccgggagagcgtgccaggctcgcttaccgggcgcgtgcctgcgctcattgaaaacggcgagctggaaaaagccgttggattaccgatggataaagagaccagccacgtcatgctgtgcgggaacccgcagatggtgcgcgatacgcagcaactgctgaaagagacccgacagatgactaaacatctgcgccgccgaccggggcatatgacggctgaacattactggtgatgttttaccgaatggcagctagggcttatccggcctgcaaatcatcaccaatctgtaggcccggtaagcgtcagcgccaccgggcaaattacggtttaccgcccgtttacggttctgccttaaacttcacgtcctgtgtcgctttcccaaacttattttccccctgaacaccgacaaacgcgcccagatcgataagcatcatcaccaggatcagcgtcggaataaatcgcccgacgacccactgccacatccccggcaacatcacccagtttccggccagcagcatccacgccagaatcattagcaacgcccacgcgccggaacgtccccggtcatgcagacgtttgaccatgacggcggcggtcggccacagcaggcacaccaggcaaaatgccgccgtttggatatcaagcaggtttttccccgccagcgaaaatagcgccagcatcccggcaaaccagaggccgatccaaatccagaaatcacggcgtccgatacgccctttaaatgagaataaccattgctgtatggtcatgtaagttccttatattttgccttccgctacagtttacccttttgacaagcccgacagttatcgttttaatcgtgagcagtcctaacgaaaggtaagattgatgaagccaggatgtactctgtttttactgttgttttctgctctcaccgccagcataacggcgcacgcgcagctctcttcatcgaccacgacagcgccctatctgctggcgggctcgccaacctttgatctttctattagccagtttcgtgagaactttaaccgccagaatcccgatctgccgctcaatgaatttcgcgccattgagaatagccgcgataaggcgaatctgacccgcgccgccagtaagattaacgaaaatctgtatgcctccacggcgctggagcgcggtacgctcaaagtgaaaagtatgcagattacctggctgcccattcaggggccggaacagaaagcggcgaaagcgaaagcgctggaatatatggccgccattattcgcactgtcgccccgttactgacaaaagagcaaagccagaaaaaactgcaaaagatgcttatcgccggtaaaggtaaacactattacgccgagaccgaaggcgcggtacgttatgttgtcgcagataacggcgaaaaggggctgaccttcgcggttgaaccgattaagctggcgttatctgaaaatctggaaggggcgaattgatgacaaaaagcaaagcctttccggggatgaatctctatactgtttcacagaccatgctgctctgacgagcggccatcttccttaattcgctgactaagcgtggagaaatgaaatgcgacatcctttagtgatgggtaactggaaactgaacggcagccgccacatggtaaacgaactggtggctaacctgcgtaaagaactgacgggcgtagcaggctgcgacgtggcaatcgctccgccggaaatgtatatcgatctggcgaaacgcgctgctgccggcagccacatcatgctgggcgcgcagaacgttgatctgaatctgtctggcgcattcaccggtgaaacttcggctgaaatgctgaaggatatcggcgcgcagtacattattatcggccactccgagcgtcgtacttatcacaaagaatctgacgagctgatcgccaaaaaattcgccgtactgaaagaacaaggtctgacgccggtactgtgcatcggtgaaaccgaagcggaaaacgaagcgggcaaaacagaagaagtgtgcgcacgccagatcgacacggtactgaaaacgcagggcgcggcagcctttgaaggcgcggttatcgcttacgaacccgtatgggcgatcggtaccggtaaatctgcaactcctgcgcaggctcaggcagttcacaaattcatccgtgaccacattgctaaagctgacgcgaaaatcgctgaacaggttattatccagtacggcggttctgttaatgcgtccaacgcagccgaactgttcgcgcagccggacatcgacggcgcactggtaggcggcgcttctctgaaagctgacgccttcgccgtgatcgtgaaagcagcagaagctgctaaacaggcttaattgccaatcaatgtctgatggcgctgcgcttatcaggcctaccagccgagtgcttatgtaggcctgataaggtaaagccgccatccggcatttatgctgtggagggtaagaaagtagtatccccggcaaccttaaacatcgccctccagctccgcgtattctcaaccagccgatcatcacgaaataacgcactaccagaaacaacacgatcgatgccctgtgcaatcagcgaaggcaactgatcctgcgttaacgacccatcaataacgataattttaccttcgcgtttatcaccaagtagacagagaagctgtgccacgcgctcgtacaaatcactggagcgcattttactgccgtatccagggttcactgccagtagttgaataacctcaacgtcgctcagaatagggataatgacatccagaggcgttgccgggcataaactaatcccccggatcaccggcatttcaccgtcaataacgggcacggtctgctgaccaagccagcttagcgtatgatgcagatgaatatcgccttcagcctgaagcgtgatgcagtgtgcgcccgctttcacgcaggcttgcgccgccgcccattgatccgctaccatcaaatgaacatctttgataaaagtttgcggcagttgcccaactgcccatggcccaacggtaaactgtgggcaaaattgaccatccatcaaatccaaatgcaacagcggctggtttaacgcttccaactgttgcagatagcgatgcaacgcaatccactgccctgccagaatacccacactaagcggatatgacgctaacaatgccacacatgcttcgcgcgttaatccggcaaactggctgttcatgagcgctccttaaggcatcaaacccataaaaactttttttgtccgcggaccggtcatcaacggttcaagctgctccacgcaagttttatagtgtggcgttgtcttgtgaaaagcgacggcctgttcatcaacgtaggcttcataaatataaaatcgcgtaggcacctgcggatcctgcagaacatcaaaacgcaagttacccggctctttaattgagcccagatgattctgccgaaaaacatcgataaattgttcaaccttgtcatcatgaacgttaatttcaaccagcgtaacgtgcatcattaaccccctgattattccaaataaaataacagtcatccccatctcctcgcatcggtaaaagatggggaagcgatctcatttaacctttctcactcaaaaacagctcataagcacgctctgctgtttcgttatgatgaacgacagcatgtaccgctttaatcatggctaccggatcttctgactggaatatattacgccccatatctacgccagaagccccctggtcaatcgcctgatagcacatttccaatgcttcacgttcaggcagttttttaccgccggcgatgacaatcggcaccggacaacctgccgcaatacgctcaaaacctttatcgacataatacgttttgataatttgcgcccccatttccgcagcgatacgcgttgccagtgaaaaataacgctggtcgcgagccatatctttacccaccccggtcactgccattattggcatcccgacgcgtaacccggcatcaatcagttgaataatatttttaatcgactgatgttcatgttcactaccaatataaacctgtgcggcagcagcacagctattcaaccgcacagcgtcatccatcgccaccgcaaccgcctcattgcttaattcagtgagaatagaatttgccccggacgcgcgtaaaacgactggtttattgattgccggaggtaccacactgcgtaatatgccgcgagtacacattaagacatcagcatattcaaagagcggcgcaatattgatatcaatacgctcaagtccggttgtcggcccctggaaatatccatggtcaaaggccagcatgaccgttttcctggtcctgggattaaaaatcctcgccagtctggactgcattccccaatccagcgcgccacagccttttaatgagaacaaagtgttagtttgtggtttatcggtgtgaaaatctttgccatctttaatatcatctaaatcagccattctttactccgtcgatacataacagttatcagaaatcatatttgtcgatattgtctttgttgaaaatgacacgctctggcaataacacaatgccgttaccttttgcctcatagtgatatccctgctcactattaggtgaaacggtgactttgccgatgccgggaatatccagtgaatcaccgacattcattggcatatttttcagcaacgcgttggcgacatatacggaaatttttccctgttggacgacatcccacaggccaaactctttaacagtgccgcgctgaacataagggcgcattacattcggcgtactaaaaccaacaatcgcgagattattacgtttaaggttctccgccgcctgtgccgcagcaggtaaagcgttagcgtcaggcgcgatgatggcatccagatcgggatacgctttgatgataccttccgccgtctggagcgatttcgtggcatcgttatagccaaactgggtagtgactatctcccaccctggatgttcctggctaattttggctttagcttcttttacccactggttctggtcggtcaccgttgggctggaatagaagaaagcgactttcgctttctctttgtccacctgatgagcggccatctctaccagcatgctgccgagctgttttggcgtcccttgattgatatagtaagaacggcactccggcttggtatcggaatcccaggttaatattttcacgcctctttgcattgcccgcttcaacgccgggcacaggccatcaggcgaaacggcagaaacgataatggcgtcatacccctgattgacaaagttattcaccagttgaacctggcctgagacgctgggctctgtagggccatcgtaagttacgtcaatgcccagcgcttttcccgcttcctgcgcgccattgccgccgctggtaaaaaagcccacgccaaccagtttgggaataaaagcaatccgctctgccgcctgcacggtcattaccgcagatgccagaccaaacgcagtgagtaaggcgatcattttaatgctgtgtcttgccatttttttctccataaatttcaaaaggaaatcatgcctgatgcgcattgcgacggcgtgagtaccattcaaggatttggtgacgatgcaaactgacggaacgaccaacgacaacaacaatgagaagcgcaccggacaatgcgctggaaatttgattcggcactccggccatctgtagcccctgctgtaaaaatcccaccagcagcgccgccaacgcggaccccataatcgacccggagccgccataaatattggcgcctcccagcacaaccgccgtaatggtcggcatcaggaaagaggcgcccagatccgaacgtgcggagccaaagtaagaaaccagtaatacggcggcgatcgcggaggcgcatccggtcatggcatacacggtatacaacgtgcgattcaccgggatcgcgctgtactgcgcgacacgggcgctctggccaatcaggaaaacgttgcgtcccatatgcgtgcgatgcatgagcagccagaaaaacagacagcacacaagaaaaaaaataagcggcataggaataccaagaaatgaaatattggcaaagtcagtgaacgctgtgggaaatccaccaataccttcataacccgtggcgccagccataccagataacaataatgcgctaccaccaaataaatacatggttcccagggtaatcaccaacgggtttacgccggtataaataataagtccggcatttatcagcccacatattgcgccgagtagtagggtaataataatcgctaaaggtagcggcataccgagctgaaacagcacacccagggtaatcgcgcatagcccgattgtagaaccaaatgaaatatccataccaccgctgacaataaccattgttagcggcaaagcgacaataccgatacaaataaaatcgctagtgctaaaaagtaagacattaatatctaataaacgtggattaatcagaccgaaagccagaatttcaaagatcaataaggctgccagcgcaatttcccagctatagcgtcgccatggattcatcatgccacctctttgtttttattctgttgtgcgtgcgtttttgcttccgcctgtagtggagtgggtggtgatataaaacgggcatatttctggcggcgcagattgcgttgtaatgcgcaacgcagccgcccatcgaataccagtacgcccaacaataccaggccagcaataaaatcgttccaccaggcggggatgcgcagcagcactaacacactatcgatttgcgtaagaaaataagcgccgagaatagcgccgatgaccgtgcctgacccgcctaacaggctaattccccccaatacgcaggccgcgatggctttcatttccagccccgtgccggtttgattgggaatgaagccaatctgcgaggcaaacacgattccagccaatgccgccataccgccattaagtgaaaatgccatgatgcgtaccatctcggtacggacacccaattgccgggcgccctgcaggttatcgccggtggcgtaaaaattgcggccaaaggcggttttcgccaggagccaggccataagcagcgctaacaccagggtaaaccagccgattgcggaaattcccagaaacaccggagcagagagttgctttaagcctgcgggtaatccttcaatccattttccccctgtccatagcagcatgatcccacgatacaagcccagcgttcccagcgtggcgacaatggcgggtatcttcaaccaggcaaccagtacgccattaaaaaatccggcgacaattcctaatattagtgtggccaggcaggcgaccggcaggctatagccggcgtttaacattactcccagcaataccgcgcacattcctgtcgtcgagcccaccgatacatcaatattgcgggtgagcattaccatcgtcgcgccaatcgccaacagcatcaaaatttgcgcgctactgaaaaccattgtcagcgtttgcacgctcaaatactggctatccagcgcgccaagaaacacgaataaacagactattgccagcagtgccgtcgcttcccggttattttggatgaatttcaacatgttgcctccgacgcaccatgttcgccaaacgcaacgtgcatgatggtatcaacgttaatttcctcgccgcataacgcaggcccccccagttccccctggtgcatgacatatacgcgatcggccatctgctctatctcttccagatcggaggaaataaacagcaccgcgacattttgttgcgcgatactgcgcaacagctgataaatatcgctgcgggcggagacatcgacaccgcgggtcggttcatcgacaatcagtaattgcggagaggcctccaggcatttggcaatcaatactttttgctggttaccgccggataaagtacgcgccgcctgttcggcattattgagtttgatatttaacgcgcggtggtaacgttcaagggtggcgttatcccgctggggctttatccaaaatcctttttggttgtgggtcagcgaacagacattccatgccagggaagcgtcaagatacagcccggatgactgccgatcttccggcaaatagaccaggccgagctgcaaccgctgttgggttgtcagggcgttaatttcttcaccattgaacagcatccgccccgcattgaccggtctaataccgtacagcgtttcagccaattctgtgcgtcccgcgccgaccaacccggccaaaccaaggatttcgcctgcccgcacctcaaggttgatattcataaaaccttcgcccgtcagtgactccagcgctaataccgtcgcgccgcgttcgttctgcgggcggctgccaggcaattccagccacaacttttgactcgcggaaagactgacgccctgcgttgccggggtgatagcttgaataatctcgtcggtagaaaggtcatgcgtttttctgaataatgcgattttaccgtcacgcatcacgctaacgcagtgagctaactgtctaatttctggcagcttatgagaaataaatacaattccgacaccctttttcagcaactcttgcagacgcgtaaataaccggtcagtttcggctggcgttaacgacgccgtgggctcatcaagaattaagattcgcgagtcgcgcatcaagccgcgcataatttcaacgatctggcggtctgcaacatcaagcgtacccgcagcgctcgccggatcgagttggcatcccatcgcctttaatagctgctgcattttttccgtggaggcctgacgtccctgcaagccaaacaagatattttcccgcacagataaactcggaaataacagaggctcctggggaaccaggtaaatgccatactggtgcgccttcagaggcgttaaatgactgcaacgcacaccagcaatatcgatagtccctccatctggcgggactataccggcaataatcttcattaatgttgatttacccgcaccattgccgccaagcaatgcgtgcacctctcccgcatgcagagtaaagtcaattccctttagtacttcgacgccggaataacttttataaatgttctgcacacaaatcagaggggatgcagtattgtgactgatttgcatgttgcctccgctccctcaatgttgactgacgggactgaacaaatgttttttgaaaaagaaattgttcaaaacggtagtagttatttggtcaaaaaactctcatccagatcacgttttctgaataaatgaatttttagatgataaatgttcagatttggcgcgtttttgtggcgttaatcacggttatttcggagtgataactgaacaattgtgttaatgatttagaaatgttcaaagtaaagccaggttatgacaatgagcgataatacgttggtatctgattatggaatgtgcgaagaagagcaggtggcgcgtattgcctggttctactatcacgatggattgacgcagagtgaaatcagcgagcgtctggggctaacccggctaaaggtttctcgtctgctggagaaagggcatcagtccggtattattcgcgtacaaatcaactcccgtttcgaagggtgtcttgagtatgaaaatgccttgcgtaaccacttcgcattgcagaatatccgcgtgctgccggcattacccgatgccgatattggtctgcgcttaggaatcggcgccgcccatatgttgatggagtcactgcggccacagcaactgctggccgtcggctttggcgaagccacgatgaccacattaaaacgcctcagcggatttatctcggcgcaacaaatccgactggtcacgttatccggcggcgtggggccgtatatgaccggaataggccagcttgatgccgcttgtagcgtaagtattatgcccgcgccgctgcgcgcatcatcgcaggaaattgcctgcacgctgcgcaatgaaaatagcgtgcgggatgtgatgctcacagcgcaagctgccgatgccgccatcgtggggattggggcaattaaccagaaagatcaagccagtatcttaaaatccggctatatcactcagggtgaacaactcatgattggccgcaaaggcgcagtaggcgatattctgggctatttttttgatgctcatggcgaaattattccagacatcaaaatccataacgaattaattggcctgaagttaaattcactttccacgatcccaactgtgattggcgtcgccggcggcgaacaaaaagcagaagctattattgccgctatgcgcggtaactatatcaatgcgctggttaccgatcagaaaaccgcagggaaaataattcaacttattgaaaaataaaaaataaaataacacttacctcaattcaataaacaataactgacaggattttatgtaacgatgtaaaaatagccgagggtaaaaaaatggctcgactctgtacccatactgaatcaggacattacctgatggctcttgacgccggtaccggtagcgtcagagcagtaatttttgatctacaaggaaagcaaatagctgtcggtcaagcggaatggcagcatctggccgtgccggatgtgcctggttcgatggagtttgatcttgccaaaaactggcaactggcttgccagtgtatccgtcaggcactacagaaagccgccatccctgcaacggctatcgctgccgtatcggcctgttcgatgcgtgaaggcattgttatttatgacagtaacggcgaacccatttgggcctgcgctaatgttgacgcccgcgcggcgcacgaagtcagtgaattaaaagagctgcacgataacacctttgaggaggaagtttatcgttgctccgggcaaacgctggcgctcagcgctattccgcgtctgctctggcttgcccaccatcgtccggatatttatcatcgcgcgtcaaccgtcactatgatcagcgactggatggcctttatgctcagcggcgaactggcggtcgatccctccaacgcaggcacgacggggttattggatctggtgacccgcaactggaaacgtagtctgttacagatggcgggcctgcgttctgacattctctcgccggtaaaagaaaccgggacactgctcggtcacatttcacagaaagcggctgaacagtgcgacctgcaagcgggtacgccggtcatcgttggcggcggcgatgtgcagttaggctgtctggggctgggcgtcgtacgcccggcgcaaacggccgtgctgggcggaaccttctggcaacaggtcgtcaatcttcccgcgccggtcaccgacccaaacatgaacgttcgcatcaatcctcatgtgatccccggtatggtacaaaccgagtctattagcttttttactgggttaacgatgcgttggttccgcgacgccttttgcgccgaggaaaaactaatcgctgaaaggttaggtattgatgcgtattccctgctggaagatatggccagccgggtgcctcccggcgcgcacggtgtgatgcccatcttctctgacgttatgcgttttaaacgctggtaccatgccgcgccgtcgtttatcaatctgtctatcgatcctgaaaaatgtaataaagcgaccctatttcgcgcgctggaagagaatgccgccattgtttccgcctgcaatttacagcaaattgccgcgttttccggcgtacaggccgactcgctggtttttgccggcggaggatctaaaggcaaattatggagccaaatccttgccgacgttacgggactcaccgttcacgtacctgtcgtcaaagaagctaccgcgctagggtgcgctattgccgcaggcgttggcgtgggtatctggccatcgctggcggaaacgggagaaaagctagtgcgctgggatcgggagcataaacctaatcctgaaaatttcgctgtctatcagcaggccagagaaaaatggcaggccgtttatcaggatcaacgcgcgctggtcgatggtggcttaacgacatccctctggaaagcgccaggcctgtaacaggagaataagcatgcaaaaaacgaatgagaagaatcatgaataccgctttagtgataatggccctaaatacttaatccgtgggccgggctgcgatatgggcgtcgtcatactacaaccagggcagtcattccctaaccatcgccataataccgcttgtgaggttttttataccctaagcggtgaagtgtgcctgtatctggaaggaacacctcatatcctgcaaactggagatgttttacagtgcgaaccaggggaggcacattatctcattaataacggcgataagccctagaaaggcgtgtttattaaatcgccgcatctggaaaatgacagccaccccgcagatccaccggcctggtaacgcccacgccatcgccagattttgccggatagcgccacgagagccttgtccggcctccaaacggcattcgttaatgcaatatcaagctgtcatttgatgacctgttggttcaagatatcacactgatgatcctgaatttcctcggcagaagcgcgattgaaggtcagtaaattacgctcggtcgccagcaggacaaaagagccatcgctttggcgtaccaccgccagcgcgctacatcactgcatccccgcccgcgcaggaactttccctggtcccatcgccaccacagcagcaaaaaatagcagtgcggtcataaactccggcagtagcgaagtcgcccacagaaggatagtaatgccaacgatgatggaagggaggatcagaggataggacaaccagagcgacatacctgtctcctgacgattttttcagcaagaatacgacggacagtcaggcaggtaaacgccagatatagtggggttatcgcaggattaagtggacagatcagtgataatgaatttcaccaaagtattcagacagcacgtaatagcggcaatactcaaaagggctgtccttcccggcctgaaacgtctgtctggcgacggataacagcggtttattgggggcgatttgcaatttttcgcacaggtcagcggaaggtaaaatcgcctcaactttttctatcgccgagtcgcttgtgacgtttaataacgaataaagcgacgtatgctccagcgcctgcggtgtgagttgcagatcgggaaagaagctaagatcgagatagatcttttcatggttaaacggacggttattcaggcaacgaatacgcgaaatatagagatagtgatgctgtgcgggcaggctcaagccgtctgcctgagcgtcgcgcgcgcggcgcggcgcgatttccagaatacggttctcaatcgccacgctggcgtcctggagatcgcgggtaataccgcgaaacgtgtgcccgtagctcacgccttccggcaccgagcacaccaccgaaccactcccgcgctgcgacgaaataatgcccgcattgattaattcgctccaggcctgtttaaccacaatcagcgagacgttgtaggatctggcaatctctttttgcgtcggtagttggctacccaaaggcaaagacccgttctggatctgctgacagatgataaaaaatagttgcttataaagcggagtaaagctcgttttatcaacctgcaagctgcgcacctcacgtcttcgccagcaggggacgttttaccgtccccggcagggtgaagtcgctaccctgcgatttgcctggccagttctgccaaatcgaaatgattcatacgatccaaagtcgttaaataatcggcgggaaaagcctccacgccatggaatgcgccggaaatcgccccgaccatggtggcgacagtatcagtatcattgccgatattaacgccggagataatagcatctacggcagaattcggacaacacgcgaacaggccaaaggccgcgggcaccgcttcactcacgtgcagcccggagccaataatatcggcaatatccactatcgccgtttcccaatggcgatgacgtttaccgatatctacggccagctcaatgcgtcgggcaacggaaggacctgccaccatcatcgccccttgctcctgcgccagcagatagcccctttgcgcaccgtaaataccggcggcaataatgctgtctgcattggtctgcgctcttaacgcctcgctggttgccgccgccatcgccgctgcgccggacatcgccagcacgttattatgcgtaaaacggcaaatctgcagcgcgcagtcaatcgccgcgtcaatatcacccgggtgcagcaccgccgctggccaaatcttcatggcggcgccgttcgttgcctccgcattacccttattaatgatctgtaccgactgtttctcgccttccagctcaccctgtaaagaggcgcggttatcattgaatattgccttcattgccgcacgcgtcgtcgggccggtaaagttggcgtagtacgggtaatccagccactgctggaaagcttcgcgcatcgcttcgtcgctgacttcacgctgatgacgcagcagcgcatccatgatgtacttcgcctgaataaaatcatccgtgcacatccccgcttcattgcagcgcccaaacgtgtccgcaggcggtttttgaaaggtcgtcacccagccgccaaaatagtcttttatttgctgctgggtgcgtacttccgtcgcggctcccatcgcgtccgcggcggcggcgcccaccaggcatcccagtattttgttttgatcaacgtgcatgatgactccttatttcacggtcatggcttgtgccagcgaatggctggacagaaaagtgtttagctggtcgggaaacggcagagcggtcattgcgccttttgccgtcaccgccatagcgccgcaggcattggcattgctgatggcttccgccagcagggcatgatcccagcaatttgcgcgggaaagggtgaacagcaggccgccgacaaaagcatcgcctgctccggtggtatcgacgacatcgacgcgtggtgcgggaaaatggaactccccctcggcggtaatcaacagcgcgccatcggcccccagcgaaatgatcgtggtgtcacagcctagatcgcgcaggtaataacgcgcatcctgccagtgactggccccgctgagctggcacagctcatctgccgagactttgcagatagaagccaacgcggcggaccgggcgatcagttcagggatttcatcggtattgcgccacatcttgctgcgtaagttgacgtcgaataacacgtagccaccggcttctcgcatgcgtctcgccccttccagacatgcttcgcgagcgggactgtcggtgaggccaattgagctgaagtaaaaccattcgtgctgcctgaacggcggcaaatcctgcggcgaaacgtaggtatcagcccccggatgcaccagataggtaaagctgcgttccccgtcagccgtcaggttgacgatcagcaccgcgctggtcagggccgcatccagccgcagcgaagagacatccacgccgttatcctgaaaaacctggcgcaggaaacgaccggcgtcatcatcaccaagacaaccgataaaaccgcactccccgcccagcctggcaacgcatacccccacgttcgccgacgctccgccggggcatttcagatagctgttctgtttttccggcaccagatcaacggaggcatcgccgataacccaaaccttattcatggccttcatttgcgcctccttatgcctgtttctgcgccagggcgagctgaatatcacgataatattcattattaatcagatactttttcatcagcagcccaaccgcaaggtggaacagagccggaatgagcgtcatcatcagcgcaataccggtgagcgaacgcgcgctctgttcaacatcggcctgatagccaaagtggctcagcaggaatccgagtatcccgcccgcgatccccatcccaaacttctggaagaagaggatgccgccaaacgccaacccggaaacgcgcagaccggttttcttttctccgtaatccaccgcttcggcgatagaggaccagaacaccggcatttacatatcgcagaagaaattaataagaaaatagaacgcaaacgccaggataagattttcacgcccgacagagaaatacatcagcgcgctcaggataaaggtaataatctgggtgtagcggaacatcttaattttgtcccagaacttggttatccaggtggtggcaatcatcgctaaaatagaggcaacgacgccggtagtcaggaagggtgaaatcaggctatctccgccgttcagataatacttggcgtaataagcggcaacggaaccgcgaataacataaccgcacatcagcagcagaataacaacgccgagaataatccactgatcgttacgtaacagatatttaaactgtttccccaccgatagcgaggtaatctccggctcgctgcgttcacgcgtggtgagaaaacagaagataaacagcagcgcacccattgcccccattaagcccatcgaaaactgatagcccaaagccttattaccctgccccagccagacggcaagcatcggtacaacgatagtcaccagaaaagcggcaatcttggtcatcacaaagcgataaccgttggcgcttaaccgctcaacggggtcgctggtaatgacgccaatcatcgaaatataaggaatggtgatcgcggtatagaccagggtcataagaatataggtgccataggcccacgctagcttggccatataagccatgtcaggcgtaataaacatcaaatacacggcgaaaccaaaaggaatggcaaaccacagcagccacgggcggtaacgtccccagcgcgtgttcagtttatcggtcagaacccccatggccggatcgataatggcatcaatcatccgcacaaccacaaacagtacgccaacatcagcggcgctcaggccgtagatatcggtatagaaataggcgaggagcagctgcatggcgataatcacaacgtttatcgccatatctcccgcgccgaagccgattttttccacgatagaaagtttcatgttgatattcctttacgcttaacagcgcaaatctggtgaacaattaatgatgtcactacatgaaataaaaacgtttttatatataagccatccatcagacaatctatggaggctatgaagagagtgtaacgaaccaccaaaagatataaaggtatacctttatatcttttggttggtttcacatatttttatagacacgatcttaccccagttttaaaccgggataagaatcaataagataatgagcaggggggtgtaacgaaaatcagcgggaagacaaaatggcgcaactatggtcctgaatctcttccgccgatgcgcgattaagcgtcagcaggttacgctcggtcgccagcagaacaaaagagtcgtcgctttggcgtaccaccgccagcgcatagcgtcccatatgatcgcgcgcttccggcacctcttccgccagcatcataaacggactacgctgcgccagttcgctctcggttacccggcgcgccaggtattcatgccccatcagatcgcccggcagcggaagccagcgagtgctgatgcgcgtgagatcgttatccagttgttcccgaacgtcaggacggatgcaagaaatatggatatgcaaatggtcctgtgaacgaccaagccgcgaattaatcgccagcgagaccgcgctatccggaatatcatgcccgtattttttactcatatagccgcgagcctgccaggccagccagaaaaagttgggcgtagcgggttccagcaatagcgggctttctgtaccgttgatacggtaggtgggcatcaataaatattgcaacggaccgtgacgatctttaaagatgacatagccggcgcgaggtttgacttccgcgcaaggcgctgggttttgatgctgtaactgatcgggcaggcaccgttcaagcacgatttcccgtaatgcatcaggattgccggaaaatttccagtaaccgacgcccgccgcggcgacaatcactatcaccgccagtaaaaagtagcctgtttttttcatgatatgcgttccctgtgacccatagacggggaagagtaacgcaaaattgtggcaaagaaaaaacccggtaacataatacgttaccgggtttataaacggtttagcgtttgctgatttggtcgaacgtaccgccattagcaaagtgatctttttgcgccttcacccagccgccaaacacctcgtcaatggtgaatagcttcagcttcggaaacgcatcgtcgtattttttcgccacgtcagcatcgcgcggacggtagaagtttttcgctgctatctcctgcccttccggcgaatagagatacttgagatacgcctccgccaccgcattcgtccctttcttctcaacgactttatccaccacggacacggtcggctctgcgaggatagattcactcggggtcactatctcgaatttatctttacccagttcgttcgtcgccagcagcgcttcgttttcccaggcgatcagcacatcaccgataccgcgttcaacgaaagtattggttgagccacgcgcaccggagtccagcacttcaacgtttttaaacagggctttgacaaagtcctgggctttggcctgatcgttattgttgtggtgcagggcgtagccccatgccgccagatagttccagcgtgcgccgccggagcttttcgggtttggcgtaatcaccgacacaccgggtttaatcagatcgttccagtcatgaatttgttttggattgcctttgcggaccaggaaaacaatggtggaggtgtaaggtgctgagttatccggcagacgcttgatccagtttttatcgatacgaccacgttcagcaatagcgtccacatcgtaagccagcgccagcgtcacgacatcggcttcaatgccgttaatgacggaagtcgcctgtttacctgaaccgccgtgcgactggcggatcacgacgttgtcgccggtttcctgcttccagtgcgcgctaaacgctttgttgtactgctcgtacagctcacgcgttggatcgtacgatacgttaagtaactgaatatcctttgccagaatgctggttgacgccagcaataatgtgaaccccacgccccactttttcatcgcccgactcgcttatgttgtgttgtgatgagcaaagcgtgccagaaagagatccaaacattaaagaataaaaaaagattggctataacttcgaggaataaatctgagggattgccggatggcggctagcgcctaatccggcctacacgtttctgcaacctgtaggcctgataagcgtagcgccatcaggcgcgcaaaaacaatcagtacagttttttcgcgcactccatccagtcgcttttgaacggacgcttcatgttttcaatcgcatcgatgatgtcatgatgaacaagctgctcgttctggataccgacacaacgaccgccatggccttccagcagcaggtcaatagcatacgcgcccatacgggaagccagaatgcgatcgtaaggtaccggggaaccaccgcgctgaatgtggccgagcaccgtcgcacgcgtttcacggcccgtttctttttcaataaagtgcgccagttcgtcaacatcgcacatatgctcagtaatagcgacgatagcgtgttttttccctttcgcgatcccggctttgatttcggccaccagatcttcgcgattaaattcaacttccggcaccacgataaactcacagccgccagcaatagccgccgccaacgtcaggtcgccgcaataacggcccatcacctcaacgatagagatacgctggtgagaagaggaggtgtcacgcagacggtcaatcgcttccactacagtgccgagagcagtgaagtagccgatagtgtagtcggtgcctttgatgtcgttatcgatagtgcctggcagaccgatgcacgggaagcccatttcagtcagacgttttgcacccatataagaaccgtcgccgccaataactaccagcgcatcgataccgcgttttttcaggttttcgatcgcgacagcgcgaatattttcgtcacggaattccgggaaacgggcggaaccgaggaaagtaccgccacggttgatcatgtcagatacgctgtaacggtcaagctgaaccatacgatcttcatacaggcccagatagccgtcataaatgcccatgacttccagcccttccgtcaacgctgcgcgcacaacaccgcggattgccgcgttcatgcccggcgcatcaccgccgcttgtcaacacaccgattttcttaatcatgactacctctgaactttggaatgcaaaatgaaatctattgccggaagccgatttcgcacttcgaaacgatccaacgaatatacagatagtataacaatcccttcctgctgaattgattcaggtcaggccaaatggcggtaatttatacacaaaatgctggcctggctcactttttaacaatcaattatacaagctcgaacttcctgccttccctggggacgactgaacagggatcctgatgaataatgacatctgaacccggaaaacgccgcaaaatcgcctgctctacctggtcagccacaaaatgcgcctgaacgagcggcagattatcttccatttccaaatgaatctgaataaagcgagtcggccctgactgccgcgtgcggagatcgtgcgcgccgctgactcccggccatgacgtcacgatatcaataatttcctgtcgttccgcatcgggcagcgcgcgatccaataatgactgcaccgcctcataccccatacgtaacgcgctatacaaaatatagatgccgatacctaacgcaaacagggcatccgcacgatgccaaccgtaccaggataaccccagcgcgataagaatcgctccgttcatcataacatcagactgataatgaagcatatccgcccgtaccgcctgactttgggtcttgcgtaccacccagcgctgaaacgtgaccagtataatagtgcatatcagagcgatgacggtaacgccaatccccacgccggggtcgttcattggcgtcggcttaatcagattctggatactggtcaaaaacaacgccgaaccggaaataaacatactttgcgccagcgccgccagcgactccgctttaccgtgaccaaacgtatgttcatcatctgcgggttgcagcgaataacgcacgaccaacaaattcgtcaatgacgcggcaatatccaccagcgagtccaccaacgccgccagaatactcaccgatcccgtataccaccacgcaaaaattttgatcaaaagtaacgctgatgccatcgccgttgccgcgatagccgcccggctaaccagccgtccataggtttgattcataaatactcccgctatcttctgccggtagtataacggatggtttaaaacagtaagctaataacagaatgacaaactggagataaaaaaaacccccacatcatgtgggggaagacagggatggtgtctatggcaaggaaaacagggttgttactgggaacgtgagttgctactactcaataatttcaacgatgaacttttttgccattgcgccacgtcgcgcagttgctccattcgttgctgatgcttttcattcaaaaccgcttgctgctccggcgttaacaggcgatacatctggttacgcacgcgggccatttcgacctggcgggcaacctgctcttgcgccattttttctgcctgagcgcgcacaacgctttcatcaaatttttctgcggtgacaagccgatgcattgtctccatttcgctaacattaacaggaggctgttcgtgccttgcctgctgcataagatctcgcatctgctgacgctgatgttcggttaaacttatgccgtcaaacatatgattttgcgcgctacgctgcgtggccccgtcaccggggtgccagttatcgcttgtaacaacttcagctgcgtggcttaaaaaactgaatgccagcgttgaggccataacagcagcggtaactttgcgcatcgcttgctcccaaaatcttttctgtcgcgattcaacgagagacagtttacgattcgggctgcaaacatgcgtcagggggtgtaaaacaacgtaaagtcatggattagcgacgcctgatgacgtaatttctgcctcggaggtacgtaaacaatgaataaaatcctgttagttgatgatgaccgagagctgacttccctgttaaaagagctcctcgaaatggaaggttttaatgtcctggtggcccacgacggcgagcaggcgcttgagcttttggatgacagcatcgatttacttttgcttgacgtcatgatgccgaagaaaaacggtatcgatacgttgaaagcgcttcgccagacacaccagacgcctgtcattatgctgaccgcgcgcggcaacgagctggatcgcgttctcggccttgagctgggcgcggacgactatttgcccaaaccgtttaacgaccgcgagctggtagcgcgcatcagggctattttgcgccgttcccactggagcgagcagcagcagagcagcgacaacggctcgccgacgctggaagttgatgcgctaagccttaatccgggtcgccaggaagccagtttcgatggccaaacgctggagctgaccggtacggaattcaccctgctctatttactggcgcaacacctcggccaggtggtttcccgtgaacatttaagtcaggaagtgctgggtaagcgcctgacgccgttcgatcgcgccattgatatgcatatttctaacctgcgccgcaaactgccggaacgcaaagacggtcacccgtggtttaaaacattgcgtggtcgcggctatctgatggtttccgcttcatgataggaagtttaaccgcgcgcatcttcgccatcttctggttgacgctggcgctggtgctaatgctggtactgatgttgcccaagctcgattcacgccagatgaccgagctgctggacagcgaacagcgccagggattgatgatagagcaacatgtagaagctgaacttgcgaacgatccgcccaacgacctgatgtggtggcgtcgcctgttccgcgcgatcgataagtgggcgccgcctgaacagcggttattactggtgacctctgaaggacgcgtgatcggtgctgaacgcagcgaaatgcagatcattcgtaacttcattggtcaggcggataacgccgatcatccgcagaagaaaaaatatggccgcgtagagatggtggggccgttctccgttcgcgacggagaggataattaccagctttacctgattcgaccggccagcagttcgcaatccgattttattaatctgctgtttgaccgcccgcttctgttgctcattgtcacgatgctggtcagttcgccgctcttgctatggctggcatggagtctggcgaaaccggcgcgtaagttgaaaaacgcggctgatgaagtggcgcaaggcaacctgcgtcagcatccggagctggaggcgggtccgcaggagttcctcgccgctggcgccagttttaaccagatggtgacggcgctggaacggatgatgacctcgcagcagcgtttgctgtcagacatctcccatgagctgcgaacgccccttacgcgcctgcaactgggtaccgcgctgctgcgtcgtcgtggcggcgaaagcaaagagctggagcgtattgaaaccgaagcgcagcgtctggacagcatgatcaatgacctgctggtgatgtcgcgtaaccaacagaaaaatgcgctggtcagcgaaacgatgaaagccaatcagctatggggcgaagtgctggataacgccgcctttgaagccgaacagatgggcaagtcgttaacggtaaattatccgccggggccgtggccgctctatggcaacccaaacgcactggaaagcgcgctggaaaatattgttcgtaatgcgctgcgctattcacatacgaagattgaagtcggcttctcggtggataaagacggtattacgatcacggtcgatgacgacggaccgggcgtaagccctgaagaccgcgagcagatcttccgtccgttctatcgcactgatgaggcgcgcgaccgcgagtctggcggcaccgggctggggctggcgattgtcgaaagcgccatgcagcagcaccgcggctgggtgaaggctgacgatagcccgctgggtgggttgcggctcacgctgtggctaccgctgtacaagcgaacctaaaaaccatcggcctgcgaatgcaggccgattttttatctcgccgtcgagatttaccgggaaatgtctggcgctaaaatccactcggcgctgtcgttccacacgtccatccgggtaattttgccatcgcgcacttcgaaacgatcgataaagcggttatcggcaaacgggcgaccgtcgggccattcgccatacaacgtaccgttggaataaatcacaacgtaatcatcatgctgcaccgcatcaaacttgcccagcgccttcttcacccacttgtagcgagcgccgttaaactgcgcgatatctgccgcgcccgccatcgcccggcctccggtgaaggtaattttcacctccgggtgcatatacgttgcggcgcgttcagcatcgggaatcatcgaggccaccaaaaattcttttacgatcgccaccgcattttcagcttcagtcataatccttcctttcattttggcggagttttatccccccacagtcgtctggcgctatcttcaattttgccgctcaaacgacgcttctgcatggtgcggctccagctcgccgacagcccggcggcgctcagcagccggtgatattgttcgtcatcaaacggcatagaccaggcgataacacccgcttcatgaaccgagacatcgctcagacgcgacgccagttccagcggcgcatcgctggagaccttacctggcgcaatgacccgatacaaccagccagtttttccgctgttctgcataaggagggccatgtcgctgatggcaaagtggaaattaagtttaaagcatggagagcgcggctgagtgacctggatcaacgcctcgccccagcggtagatgtcgccaataaacacgttgtgttcggtcattccgtccgtcgacagattctcgccaaacgccggggcgcaaaacagcgtcgcctgctcggggaactggcgaatccaatcagcatagtgttcgcgggggtaatgacatagcgcgcggtcggggccgccgtggattttcttttcggcctgctgatcgcctgccagacccagctcggtcagcatgagttcgccgtcgatttgcaccttggcgatagcgctcgggcggctgccgtcatagtcacgaattttgccaataaacacgtcaaccggataatgcatctgctgctccttacgcggatacaaaaaaagcgagtcatcagactcgcttctacagacgtgcaatgcaaattattttttagcggcgaaacgcgctgctgcttcgtcccagttcaccacgttccagaactctttgatgtagtccgggcggcggttctggaatttcagatagtaagcgtgttcccacacgtccagacccaggatcgggaagccggaagcgccggaaatggcttcacccatcagcggggaatcctggtttgcggtagaaaccacagccagtttgtcgcctttcagcaccagccacgcccagccggagccgaaacgggttgctgctgctttttcgaattcagctttgaagttgtcaacggaaccgaagtcacgctcgatagccgctttcagatcgccctgcagagtggtgccttttttcagccctttccagaacaggctgtggttagcgtggccgcccgcgttgttacgcagcacggtttttttgtccgctggcacctggtccagtttagtaatcagttcttcaaccggcaggtcagcaaactcaggcagattttccagcgccgcgttagcgttgttgacataggtttgatggtgtttggtgtggtgaatctccatcgtctgcttatcgaagtgcggttccagtgcatcataagcgtacggcagggatggcagtgtataactcataatcatctccattattgtcgagcggcacagtgttaacgccgcgtaagcagttggttcattatagttaattaaatgatattgaaaatgattatcaatgccgtactttttccagggttataaacgttacggcatccgctgaaaaaaaccgatttttacgcctccaaccgaaaccgcctgttgatgaattcctggaaatcatgaaatgtgaaacagggtttcaaaatctttcttttggtgccaatttttatcagcggtggcaaaatcaagaaggttataatttcaccatgcaattacattcccggtaaattattacaattgcgagggaattatgaagcaacctggttttatacgtctggctacgttggccttactctccacactctctttcttctcccacggcgaaaccattttgcgcctggcctacgctgaaaatagccagccggtaaaagatgcgttgcacttcctggggcagcaagttgaagagaaaacgggcggcgatatcaaagtacagtacttcccggacggacagcttggcggcgagcgcgaactggtggagttgacgcaggtcggcgtcgtcgacatcactaaagtgtcgtccgggctgatggagagtttttcgcctgagtacggcgtgttctcacttccctacctgtttgccaccgtcgatgaatactaccgcgtaatggataacccacaggtgaggagcctgtttatcagtccaccgccgcacagggttttgtcggcgtaggctggtatgattccggcgcgcgtaatttttatatgagcaaagcgccggttaaacgcattgaggatttacgcgggaagaagatccgcgtcatgcagagtgagacggcgatccaaactctcaaactgctgggcgcttcgcccatcgccatgagccaggcggaggtctatacctcgttacaacaaggcattctcgacggcgcggaaaacaatgagttcgctctcaccatcgcccgccacggcgaagtcgcccgttattacacctacgatatgcacacccgcattcccgatatcctgctaatgagtaccctcacgctggaaaagctgacgccggaacagcagcgcatcgtcgaagccgccatcaaggcgtcgatcgaatttgagaaagccgcatgggacaaggaaatagagaaaaccaggctggcggcggtaaaagatttcaacgttgaattctacgagatcgacaaaaaacccttccagaaggcagtacagcctatttacgacggtctgaaaaacaaaccgcggctttacgggctgtatcaacgtatccagacagcaaaaaattaatctaatcaggaaattaagatgaacacattcagaaaaggacttgatttattgctgggcgctatctgttgcctggtgctggcgataatggttggcatcgcctgctggcaggtggtgagccgctacattctgggcgttcccagcacccttaccgaagagatgctgcgatttctcctggtgtgggtatcaatgctgggcatggcttttgtcgccggtcagaaacagcatatcagtctgactatcttactggataaggtgtcgccgacgattcgcggctggtgggatatcatcctgcaggtcatttttatcgcgttttccatttgggtattgattatcggcggcttaaagatttctgcgatttctatgctgcaaatctcccctgcgctgggcattccgatggggaaaatttattacgcgctcccctgcgcgggcatactgatcatcctctatgggctactgaatatcgttgacgccctgaaagctatccattccgccacggataccactgagcacactctggagaaatcacatgattgaccctatttttgcgtcctgtacgctaattgccgtctttgttgttttactggccatgggcgcgcctatcgggatctgcatcgttatcgcctctttcagcaccatgatgctggtactgcctttcgatatttcgatgttcgccaccgcgcaaaaaatgttctccagcctggacagttttgccttgctggccgtgccgttcttcgttttgtccggggtgatcatgaatagcgggggaattgccgcccgactggtcaattttgccaaactgtttactggcaaactgcccggctcgctctcttacaccaacatcgtcggcaatatgatgttcggtgcaatttccggatcggcgattgccgcctcaacctctatcggcggcgtgatggtgccgatgagcgcgcgcgaaggttacgatcgcggttttgcggccgcggtgaatatcgcctccgcgccgacgggaatgttaattccgcccaccacggcttttatcctttatgcgctggcaagcgggggaacatcgattgccgctctgttcgccggcggtctggtcgcgggagtgctgtggggcgttggctgtatgctggtcacgctggtggtcgctaagcgtcgaaattatcgggttttcttcaccgtccaaaaaggcatggcgctaaaagttgccgttgaggccattcccagcctgttactgatcgtgattattgtcggcggcattgtgcaggggattttcaccgccattgaagcctccgcgattgccgtggtgtatacgttattgctgacgatagtgttttaccgcacgctgaaaattaaggatttgccttcgattttgctccagacagtggtaatgaccggggtcatcatgttcctgctggcaacctcttcggcgatgtccttctcgatatcgatcaccaatattcctgcggcgctgagcgatatgatcctcggtatttccgccaataaactggttatcctgttagtcattaccgtctttttgttgattatcggcgcatttatggatatcggtccggccattctgatttttaccccgattctgctgccgattatgactaaactgggcgtcgatccggtgcatttcggcattatcatgatctataacctggcgataggcaccattacgccgccagttggcagtggtttatatgtcggggcgagcgtcggtaaggtcaaagttgaggacgttatcaaaccgttgatgcctttttacggcgcgattatcggcgttctgttattaattacctacattccggaaatcacactgtttttaccccgtctactgggcatcatgtaaggcatagtttcctgcacatctcgttgccggatggcgattcgcgtcttatccggccaacgcgcgataataattatccgcaggtcatcaccaggtaaaaaaaccggctacctataaagtagccggaaaagggaataaataataaacagggataatgattagaatgtgtagcctatacccacgcggaaacgggtttgtctttcatcgctgttgctattgacggaaacattacctacctcaacgaatggcgaccattggtcaataatataggcagttctgaagttatattcatagttatctttgccgccatcgtaaagatcatatttatcggctttcttataaattccttcgattgtccagtcaaagttgttccatttataacccgcccagacatccatacgattgatggtatcatcatcacggatatcagaagaacggcgtacatattcaaaacgatagcgcgcgccaacccaccaactttcatttaatgtccacgtcgcgcggaagtaaggcttataggtagagtaaccgttgcctgtttccagcacaaaacccggttgccaggcgacatcaccggttttaaattggtagcttatcgtatattcgttaccctgtgtttccaggtcattaaacgctttattggtgtcatccccgcctgattttgagatagcttctatcgcaaaaccaacaccattcgcaaaccgatgagaaatatacgcacggtcatagttagctttactgtcatcaagatattcatgacgaacatcgacatatactgcatgcgcatttgttacaacaagaggtaatagtaagaaaagagattttctcataacagaatccatttaatttaaaattaaaacgttgtttcatgtcagaccgttacaaccataatacgcaatgtgaatggcgacaatataggcaaagatctttaatttaaaattgggataatgttcaaaaagcaaaataaaataaatgaaatttatattcgtcatataaaataaaaatcaaaactccatcaacaacgccaatatagggatttccttatatttatatttcattgattcctaacgttaatttcaatatatttaaattgtaaatacaaataaaacaactaaataattactgtataactacccttttatcaaacggtaagtcagactattcccattatgtgatctcacgcagcgttttctttgcattactgccagctaagtcgtttcgtgtcgttatgatgaaggtattttagaaaacaaatattacccactgatttaaataacatccagacggtcacgatgcgctccgacttttttaaaacgtgaagttaatcacttcattaacgtgctgattgccagaatacacccaacggcggcaatcgttataaggttaccaggctgcgtaatttttaaactcatgcaaacggaaggggtatcccgtccataaaaaataatgaggaacatgtcatgagtaacgcgattacgatgggtattttctggcatctgataggggcggccagggcaacctgcttctatgccccgttcaagcaagtgaaacagtggtcatgggaaaccatgtggtcagtgggcggcatcgtctcatggcttattctgccgtggacaattagcgctctgttactgcctgatttctgggcctattatgggcagtttaacctctccacccttttaccggtttttctgttcggcgccatgtggggcatcggcaatattaactacggcctgaccatgcgttatctcggcatgtcgatgggtatcggcatcgctatcggcattacgcttatcgtcggcacgctgatgacgcctatcatcaacggtaacttcgatgtattaatccataccgaagggggacacatgacgctacttggcgtttttgtcgcgctgatcggcgtcgggattgtgacgcgcgccggacagttaaaagaacgcaaaatgggcattaaagcggaggagttcaatctgaagaaagggcttctgctggcagtgatgtgcggtattttctcggcggggatgtcttttgccatgaacgccgcgaaaccgatgcatgaagctgctgccgcgcttggcgttgacccgctctatgtcgcgctgccgagttacgtggtgattatgggcggcggcgcgctggtgaacctcggtttctgttttatccgcctggcaaaagtgcaaaatctgtcgataaaagccgacttctcgctggcaaggccattgattatcagcaatattctgctgtccgcgcttggcggtctgatgtggtatttgcagttctttttctatgcctggggtcacgcgcgcattcccgcgcaatatgactacatgagctggatgctgcacatgagcttctatgtgctgtgcggggggcttgtcggtctggtgctaaaagagtggaaaaatgctggccgccgtcccgttgccgtattaagcctcggctgcgtggtaattattatcgcggcgaatattgtcggtttaggcatggccagttaatcgctttgattactgagatggcgccattggctcggcgtcatcccggtttcccgcgtgaacaccactgaaaaataattactatcttcaaagccacactgcatcgaaatctcgctaaccatcagcgggctatgctgaagcagatactgcgcgtggcaaatacggacctggcgtaaatattgattaatcgtcatcccggtttgggcgcgaaactgctgccgcagcacccgctcgctgcattgttcctgctggcaaaacgcatccagcgcaaagggacactcaaggctattagccaaagcggtaattaatttatccaacagggtttctcgggaggttgccggaagatcgtcggtcgcgtagcgatgccgttttaacgtcattaccagttgaccaaacagcaattccgccatctcattcgccagcggatcgcgtccattactctcatgttcaagctggttaatgacctgccgcgcctgattcattcccatactgcccagccgccagtgaggatgccactgcgctccctgaaagccgggaatcatcgcctgccagtttacattgagtttcaaacgctccgggcagtaaataatattttgcagcaccagatcgttaacggaagtataggagtgtttgtcttcagcacgaatgtaaaacagatcgccgcgggtaattctgtatgggcgctcattaagaacgtgtaggccattgccccgccagaccatcaccagttcacaaaactcatgcgtatgttccgcaaaaacatcctgtggatagcgatcggcaaccgtaacggcctgctgctcatcagtaaaaaaatcttttttcaaaaggattaactgatttgccaccgcagcacctcatgttgaatgcttgccggctggcgctacgcttattctgtctaccgctcgccgccgtaggccaggtaaggcgcagccgccatccggtattaaagggtataattatcagcatattggcgacgaaaacgttgatagcgttcgcgttactggattatcgcatcgcgtccctgacggatatcccgcggcgaccagttaaattctcggcgaaacagagtcgaaaagtggttactgtcgccaaaaccgcagcggtacgcgatttctgtcacgctatgatcgctatggcgcaataaatgccgggctttgatcaaacgcaggcgattaaggtaacgttgcggcgtcagcccggtatgctgtttaagctgacgatgcagcgtacgtagcgacagcgaaaactgttcagctaccgcctcccagcagacctcctccgcaaaatggtcttccagccatgccatcagttggttgagtttggcgtcgttattggtcgcgccttccatcaggctactgcggcgtaacaacaccagtagttgcataaacaaaatttcgcgattcgccacggcaggcgcatccatgccgtctccggcgcgctccatcagaccgaccaactggcgcacctgctgcaacacactctgattcacccgccagtgagaaggatagtaaccatcctgctcctgcggcagcaattgatccaaccccgccaggaactggaaggcgtccggtgaacgccacagtacattcgtcaggcataggttgtcggtatgttcatataaatgccggtcgtgatcgcgaacaaaacacacggtaccgccgctgatggtatacggctgcccgttgaatacatgaatgcccgtaccgtgttccacaatcacgatttcatgaaaatcatgatgatgttcagggaaagcggcttgcggcagacgaggttcaatcgccacgggcgctttacctgatggaaaaaaatccacgctatgcagtacggtcatggttgcttcctcctgaattcaacatgtccgaatagtaattaagggttatcggcctcaccttaaatttttgacgctaaagcgcgcaaacatggtctttttttcaagaaaaggcgggaaaaagcgggaaatgcggacgacatcacaccggcctattagtagaaactgtgaacgctatcacgttcatctttgccttgttgccagcggctcattttcctgtcagtaacgagaaggtaggtctttgagggcttttttagactgtgcgcaatgactctaagaaggacctgattatgacttttcgccattgtgtcgcggttgatctcggcgcatccagcgggcgcgtgatgctggcgcgttacgacagcaaacaccgtaccctgacgctacgtgaaattcaccgttttgtgaactgcctacaaaaaacagacgggtttgacacctgggacatcgacagtctggaaaaggatatccgtcttggtctgaagaaagtctgcaatgaaggcattcttatcgacagcatcggcatcgacacctggggcgtcgattatgtcctgctggataaacaaggtcagcgtgtcggcctgccggtctcctaccgcgataaccgtaccacgggcatcatgccgcaagcgctggtccagatcggcaaaagcgaaatctatcgccgcagcgggattcagtttctgccgtttaacaccatctatcagctacgcgcgctgacgaaacaacagcctgagttaacggcgcaggtcgctcatgcgctgctgatgcctgattatttcagctaccgcctgaccggtgaaatgaactgggagtacaccaacgccacgaccacccagttggtcaatatcaataccgatgactgggacgataccctgctggcgtggaccggcgcgaaaaagagctggttcggccgcccctcgcaccctggcaatgttatcggcgactggatttgcccgcagggcaaccgtattccggtggtagccgtcgccagccacgataccgccagcgccgttattgcctctccgctggcaaataaacatagcgcttacctgtcttcaggcacctggtcgttgatgggttttgaaagcaaaaaaccctacaccactgatgaggcgctggccgccaatatcaccaacgaaggcggcgcggaagggcgttatcgggtactgaaaaacattatgggtttgtggctgctccagcgcgtgctgaaagaacggcgcattaccgatctgcctgtgcttatcgcccaaacagaagcgctgccggcctgccgtttcctgattaacccgaatgacgatcgctttatcaatcctgacgatatgcgcgccgaaatccaagccgcctgtcgcgagaccgaccagcccgttcccgtcagcgatgccgaactggcgcgctgcattttcgacagtctggcgctgttgtatgccgacattctgcacgaactggcaaatctgcgcggcgaaaaatttacccaactgcatattgtcggcggcggatgccaaaacgcgctactcaaccagttgtgcgccaatgcatgtggcattcgcgtgatggccgggccggttgaagcctccacccttggcaatattggtattcagcttatgaccctcgacgaattaaacaacgtcgatgatttccgtcaggtcgtcagcgctaactacgacctgacaacctatatccctaatcctgatagtgaaattgcccgccacgttgcgcagtttcaacccaaacgacagacaaaggagctttgcgcatgaccactcaactggaacaagcctgggaactggcaaaacaacgtttcgccgcagtaggtattgatgtcgaggaggcgctgcgccagctcgatcgcctgccggtttccatgcactgctggcagggcgacgatgttgccggattcgagaacccggaaggttcgctgacgggcggaattcaatcgaccggcaactatccgggcaaagcgcgtaacgccaccgaactgcgcgccgatctggaacagacgctgcgtctgatcccaggccccaaacgtctgaacctgcatgcgatctatctggaatccgatacgccggttgcccgcgaccaaatcaaaccggagcattttaaaaactgggtggagtgggcgaaagcgaaccgactggggctggatttcaaccccacctgtttttctcatccactgagcgctgacggttttaccctctctcatccagacgcgaaaattcgccagttctggatcgatcactgcaaagccagccgccgcgtctcggcatactttggtgagcagctcggtacgccgtcggtgatgaacatctggattccggacggcatgaaagacattaccgtcgaccgtttagccccgcgccagcgcctgctggaagcgctggatgaggtcattagcgagaaattcgacccggcgcaccacatcgacgccgttgagagcaaactgtttggcatcggcgcggaaagctacaccgtcggctccaatgagttctacatgggctacgccaccagccgtcagaccgcgctgtgtctggatgcgggccacttccatcccactgaagtgatttccgacaaaatttccgccgccatgctctatgtgccacggctgctgctgcacgtcagccgcccggtacgctgggatagcgaccacgtggtgctcttggacgatgaaacccaggcaattgccagcgagatcgtccgtcataacctgttcgaccgtgtgcatatcggcctggatttcttcgacgcctctatcaaccgtgtcgccgcgtgggttatcggtacccgcaacatgaaaaaagcgctactgcgcgctctgctggaacccacagatcaactgcgtcagcttgaggccagcggcgattacaccgcgcgtctggcgatgctggaagagcaaaaatctctgccgtggcaggccgtctgggaaatgtattgccagcgtcacgacacgccggctggcagccagtggctggacagcgttcgcacctacgaaaaagagatcctgagcaaacgtagctgacagcgacacctgatctgtaggccggataaccttcgggcaataaatgggaacacgaatatgcaaaatattaccgattcctggtttgtccagggcatgattaaagccacgtctgatgcgtggctgaaagggtgggacgagcgtaatggtggcaacctgacgctgcgcctggatgaagcagacatcgcgccatttagcgccgatttccacgaaaaaccacgctatatcacgctaagtcaactcatgccgctgctggcgaatacaccgtttatcgttaccggctccggcaaattcttccgcaacgttcagctcgatccggcagccaatttaggcgtggtcaaaatcgacagcgacggcgctggctaccacattctgtggggcttaacccacgacgcggtacccacctctgaactcccggcgcacttcctctcccactgcgaacgcatcaaagccacccacggcaaagaccgcgtcattatgcattgccatgcgactaacctgatcgccctcacctacgtactggaaaacaacactgcgctgatcacccgcaaactgtgggaaggcagcaccgaatgcctggtggtattcccggacggtgtcggcattctgccgtggatggtgccaggcccgatgaaatcggccaagccaccgcgcaagaaatgcagaaacattcgctggtactgtggccgttccacggcgtgttcggaagcggacctacgctgaatgaaaccttcggtttgatagataccgcagagaaatccgctgaggtattagtcaaaatctattcgatgggcggtatgaagcagaccatcacgcgcgaagaactggtcgcactcggcaaacgatttggcgtgacaccgctggccagcgccgtagagctgtactgatacctcccaactcaacgccggatgcggctttgccttatccggcctacaggtcggtgcgcattttaccgtaggcccgataagcgtagcgccatcgggcaacagggaatttttttaaggagaatagtgatgagctttatgttggcactgccaaaaattagcctgcatggcgctggagcgattgccgatatggtgaacctcgtggcgaataagcaatggggcaaagcgctgatcgttaccgatggtcaactggtaaagctgggcctgctggatagcctgtttagcgcactggatgaacatcaaatgtcttaccacctgtttgatgaggtgttcccaaacccgacagaagagctggtgcagaaaggttttgcggcgtatcagagcgcagaatgtgactacattatcgccttcggcggcggcagcccgatcgataccgcaaaagcggtgaaaattctgaccgccaacccaggtccatctaccgcctactccggcgtcggcaaagtgaaaaacgccggcgtaccgctggtagcgattaacactacggcaggtaccgcggcagagatgaccagcaacgcggtgattatcgactctgcccgtaaggtcaaagaggtgatcatcgacccgaatatcatcccggatattgccgtggatgacgccagcgtcatgctggaaatcccggcgtctgtgaccgccgcaaccgacatggatgccctgacccatgcggtggaagcctatgtctccgttggcgcgcatccgctcaccgacgctaacgcgctggaagcgattcgcttaatcaatgtgtggctaccgaaagcggttgacgatggtcataacctcgaagcccgtgagcaaatggcattcggccagtacctggcgggtatggcgttcaacagcgccggtttggggctggttcacgcgctggcgcaccagccgggcgcaacccacaacctgccgcacggcgtctgcaacgctatcctgctgccaattgtcgagaactttaaccgtccgaacgccgtcgcgcgttttgcccgcatcgcacaggcgatgggcgtggagacgcgcggtatgtctgacgaagtcgcaagtcaggaagcgattaacgctatccgtacgctgagcaaacgcgtcggcattccagaaggtttcagcaagctgggcgtcacaaaagaagatatcgaaggctggctggataaagccctcgccgacccgtgcgcgccgtgtaacccgcgcaccgccagccgcgatgaagttcgcgagctgtacctggaggcgttatgatccgcaaagcctttgtgatgcaggtaaatgccgacgcgcacgaggagtatcagcgtcgtcataacccaatctggccggagctggaagccgtattaaaatctcacggcgcgcatcactacgcgatttatctcgatcaggagcgcaatctgctgttcgccaccgttgagattgaatccgaggagcgctggaacgccgttgccagcaccgacgtttgccagcgttggtggaaacatatgcgtgacgttatgcccgcgaatccggataacagcccggtcagcgcagagctaaaagaggtgttctatctgcagtaagtcgtgtgcccgatggcgcaagcttaccgggcctacggttttattttttgtcggccggataagacggttacgccgccatccggcaatttcaattctgctccgctaccaggatagcctgagtatccggttccagcgctttaaagatatgcgcctggtcgccgggataacaaatgtaatcgccctccgccagctcttccggcgcctcggttaagccgacgagggcttttccctgcgtaacaataatatgttccaccgaccccggcggatgcggatgagagatccggtcggcccccggctgcgtcaacagcagatagatatcacgccgcgcgccgggcggacacgccgccagtaatatcgcctgataatgcgcctgctccgccacgactttggtgccttctccgcggcgaatcacctgcgttttttgtacctgcggctccagcagcctggcaaagggaatgtcgagcgcgacgcatagcgaccatagcgtctccaggctggggttgccgttccctgcttccagttgtgaaagcgtagatttagcgatgcctgcgcgccgcgcaatctccgccagcgacagtccggtttgctggcgttcgcgtaccaggcttctggcaatgacgctaataggttgtgtcataaagcatccaacgttcactataacgaacgaaatgttcgtcttgtaaagcaaatctgttccgttcattataatgaaaattcgttcgatatgactaaagaagatgaaacactatttttcctgtctcaagggagacacgataaaagcgatatttttagtgtgcctggccgtgggcgtcgtcggcatgtcctatggctcactggcgatggcctacggtttcccactgtgggtgccgtttgtcctctctatttttgtgctggcgggcgcgtccgaatttatgtttatcggcattgttgccagcggcggcaatccgttagcggcggcggcggcaggactactggtgaatgcgcgccacgtgccgtttggcgtaacggtgcgcgatttggttggcacccgcgccgccagctttttcggctgccatatcatgaatgatgagagcgtggtgttcggcctgtcgcaaaaaacacccgaacaacgtaaagccgcctactggctatgcggtctgggcgtcgccctattctggccgattggcacactgattggcgcaggtgtcggcaaactgctcccggccccagaaaccatcggtctggacgccgtattcccggcaatcttactggcgctggtgatcccggcgtttaaaaaccgcaccacattgattcgtggttgcagcggcgccgcgctgtcgcttgccgccgttccctttgtggctgccggattgccggtgttgctttcgctgcttggcctactggcgaggaaaaaataatgggcaatatgacgctatttattatcggtattgctcttttatctacgggaacctatttgatgcgcctcggcggcgcgaaacttggcagccgtctggcgctgtctgagcgttcacaggcgctgctctcggatgcggcaacggtgctgctattctccgtcgcgctggcgaccaccttttacgaaggcgaacattttgccggaatggcgcgcgttcttggggttggcttcgccgtatttttagcctgacgtaaaatgccgcttattgtggtgattatcgccgctgcagtggtgaccgcgttattacgaatggcgggtattaattaacgtcttacagaacagttggacgtgacaccctataagtgatgaaggctgggccgccctatgctgaagtggctcagaattttcgcatcagggggataaatgttttccatatgaatgccgattctcaattacactatcagagtaacttcaacatcttgtgatagcttcagattactggttttcctaatagctctccttagttaaggtttacgtcagctatttttacggatattgcctgacgaaatgcatgaacgaaaaaagcgcctgatcggcgctctttattggtgttatagcgtaactttataggcgcttacgccagcctgcacgcagttaatgtgccgtcactcaacgcaggcggttataatcatccaccatctcgttataacttctcaacgacgccggataagaatccgcaaccatccatcctgttgcagggtcctgcacccgtttcttttcaaaatcagaatactcaacattgtctctgatgcgacgaatatattttttagcttgtagctgataatcagccgcagagctgatgaaagaagaattacggccatcagtattcacttctttcaattgcgcaatcattgtttccagttccgcgacttttttcatcatcgcttcggcatcaaaggtatcggcagaaataaccttgttgatctgctttgccgaaatcatgacagccagagaataatagttaaatgttttaccttccgcttcttctattttcttcaactgtgtcaattgccgcttgtcatttatttcctgaatagcctcatgatatttttccgagataggtttaaaatcctcgatattcttcagtaatgtctgatgcagcgccttacctttagcaaaaccatcatctttatagttttcctgggtataatatttttccatttcgttaatggtattacccagcgcggcggcgctatcaatatagctaacggcaacgccatcaataggctcaagcaatggcgttaaggcggccacctgtttcatctctttctggcaattcgttatgtaagactccgtaataccataaatgccataaaccaggctctctttccctgtcggaccttttttaaagtctttcacccaatccgcgtaacgcgccagactgtgctgaacgggcaattgaagtttattaaaacaatcgatatagacatccattttttcactataaacttcttcagcgtcaacctccggctgagctggcgtttctggcttcgccgccgggggctgagttgctgtttctggcttcgctgctgggggctgcgctggactttcgccagattgcgtttccggcgtctgagaaggcgctggcgtcgcaggctgactgctggcggccggcgtcgcctcggttttaacattattgtcatcacatcctgttgcgcccagggtcattagcgcaatgattatcgctgaggataataaattccttttcatttaattgccttttgtatatttacgttggggttctcttattttaacgaacacattgatattgataatgttaattataatgaaatatggattaagtattttttgtgttgaataaatcacatacctgtttttttcattaaaatgaatctgtaaatttcaatgatattatttataggttattctaatgaaaaaggatttgttatcatcaattattatcgctatgctgatgactgccgggctaagcgcttgtgatgaaaaaaaagcggacgaacaacctgtagctcagagtgcggattcatcagcgagcaatacacaatccacatcagcggaaagcgcagatgcgaacgatgttcttaaccaaaagctgaatgtttacattgattgttataataatctccaggcagatatttaccgtgctgtaaatcgttatgctaacacattcgacgatttccgcaccggtcctaccggtaaggaagacgatccctctccgctggttcctgtgtatcctgcatttatccaggactgccggaaagacatcaaggcggcggctgaattaaagccggcgtttgcctctctggatagtgctgctctggcatttattaatgcggctgggccactagctgaaacaatcaatagtatgaataaatactatgatcaagataacttcaaggatgatgcctttgctggcgctaaagcgttccataaaacgtttataaaacagttcgatgagtttgatcccattgcgaaaaaatatatcgccgagattaccattatgagtaagcagcatgcggctaatgaaattaaggcgaccgagaagaaagaaggtaaatccattaagtactatacgcttttgacgatgcaggaagccgagacgcttaatgacgctgtagctgatgcttcttttgatgtggcggcagtaagcaaacagctcgctgattttgaagagcatactcagaagctaaacgagaagatcaacgttgatatagataaacatcgtagcttccctggttttatttctgagctggaaaaattccagggcaaggtgaaaaaacgcattcggcgcgtgcgcgataacgtggcgtatacctcgcatgagcaggactacctcaatagcggcagcggcgatatggtagatggttcttataaggctgtggttaaagcttataacgagctcatcgacacctataatggctatcatcttgagcgtgagttctaagcttttcacgctgcaaatcgcgtgcatatgaccgctgaactgagcaaataagtcgttaccgactgtcgaaagagcgccccaggggcgcttttttcgttcgaagtattaccgggtagcaagcgcctcgttaatgactggaataagctgcggtccagcttaaaaacgattaaaacctgtatggcctcgccactatacgtgtatacgtgattccgttatcaagagaggctgtaaaattgagaaaatatatattttacgaaaatgtagagggtactattttagtctgcgattaaccgctgcggatgggtataaatcgtcgcccgacccggcttacagaaccccaccagcgtaagattacaccgttcagcgacgtcaaccgcgagcgtggtagcagcagaaaccgcaaacaaaatttccacaccgcacatcgccgacttctgcaccatttcgtaactcgcacgactgaaaaccagcgccgcgccttgccgccattcctcaccttccgtagcgcggcggccgagcagtttatccagcgcaacgtggcgtccgacatcttcatggccccccgccagttcacccgacggcatgacccacgccgcagcgtgcgtacaacccgtcagcttacccgtcggttgaaaatcattcagatgttttaacgcgcgatcaaggttaccgagattaaacgtttggctaaacggcagcggttgcaccggcttaccaatgtcattgagctgttccacgccacacacgccgcaaccggtgcgtccggccagcgcgcgacgacgcgctttcagccccataaatcgacggctggaaagatcaatctgcacttcaagtccgttacaggacggcacaacgtccatgccatagatttcacgcgggctgtcaatgatcccttccgacagagaaaaccccattgcgaaatgcgtcagatctttcggagaggccatcataacgacatgcgaaatgccgttatacaccagtgccactggcacttcctcggcaacatcatcaagttgggaggactgcaaatcctcgcgtttccagagtgtcaactggcgtgaggttgtgaaatcagtcacatttaggacttcttcagacagtatattgttcactttcttttaaccatataagaacacacacaccaacattatggtattctgttacaactcctcccggatggaggaaaatttatccaattctgaacctttgcgggcccgtccgcaaagaaaaataacaaccactccctgagcgtttcagatagagaaatgtgaaagagaagtgacaatgtcgaaacaaggagcaaaccatgcaggtcagcagaaggcagttctttaagatctgcgctggcggtatggcaggcaccacggcggcggcactgggcttcgcgcccggcgtagcgctagcggaaacacggcaatataaactgctgcgcacccgcgaaacccgtaacacctgcacctactgttccgttggctgcgggctgttgatgtacagcctcggcgacggtgcgaaaaacgccaaagcatctattttccatatcgaaggggacccggatcatccggtaagccgtggcgcgctgtgcccgaaaggggccggtctggtggactttatccactctgaaagccgcctgaaattcccgcaataccgcgcgccgggttcagataagtggcaacagatcagttgggaagaagcgtttgaccgcatcgctaaactgatgaaggaagatcgcgacgccaactatcaggcgcagaacgccgaaggcgttaccgttaaccgctggctcaccaccgggatgctgtgcgcttccgcatccagtaacgagacgggttatttaacgcaaaaattctcccgcgcgctgggtatgctcgcggtcgacaaccaggcgcgtgtctgacacggaccaacggtagcaagtcttgctccaacatttggtcgcggtgcgatgaccaaccactgggtcgacatcaagaacgccaacctcgtcgtggtgatgggcggtaacgccgcagaagctcacccggtcgggttccgctgggcgatggaagccaaaattcacaacggcgcgaagctgattgtgatcgatccgcgcttcacgcgtaccgcgtcggtggccgatttttatgcgccaatacgctctggtactgacattgccttcttgtcaggcgtgatgctgtatctgctgaccaacgaaaaatacaaccgtgaatacaccgaggcctataccaatgccagcctgatcgtgcgtgaagattttggcttcgatgatggtctgttcaccggctatgacgcagacaagcggcagtacgataaaaccagttggcactatgagctggacgaaaacggttttgccaaacgcgatacgacactgcaacacccgcgctgtgtctggaatctgttgaaacagcatgtctcacgctatacgccggacgtggtagaaaatatctgcggtacgccgaaagcggacttcctgaaagtgtgcgagtacattgcagaaaccagcgcaaaagataaaaccgcgtcgttcctgtacgcgctgggctggacgcagcattccatcggcgcgcagaacatccgtactatggcgatgatccagcttctgctcggtaacatggggatggcgggcggcggcgttaacgccctgcgcggtcactccaacattcagggactgaccgacttaggactgctgtcgcaaagtctgccgggctatctgacgctgccgagcgaaaaacagaccgacctgcaaacctatctggctgccaatacgccgaagccattgttgaaggatcaggtcaactactggggcaactatccgaaattcttcgtctcgatgatgaaggccttctttggtgataaagcgacagcggaaaatagctggggcttcgactggctaccgaagtgggacaaagggtacgatgtactgcagtacttcgagatgatgaaacagggcaaggtcaacggctatatctgccagggctttaacccggtggcttcattcccgaacaaaaacaaagtggtcgcgtcgctttccaaactgaagtacctagtgactatcgatccgctcaacacggagacctccaccttctggcaaaaccacggtgagtcgaacgatgttgatccgtcaaaaatccagaccgaagtgttccgtctgccttccacctgttttgccgaagagaatggttcgatcgtcaactcgggtcgctggctgcagtggcactggaagggcgcggacgccccgggaattgccatgaccgacggcgaaatcctcgccggtatcttcttacgcctgcgtaagatgtactctgaacagggcggcgccaacccggaacaggtgttgaatatgacctggaactacaccaaaccgtacgaacccgcctctgaagaagtggcgatggaaagtaatggtaaagcgctggccgatcttatcgacccggcaaccggcgcggtggtagtgaagaaaggtcaacagctcagttcgttcgcgcaactgcgtgatgacggtacgacgtccagcggctgctggattttcgccggtagctggacgccggaaggcaacatgatggcgcgtcgtgataacgccgacccgtctggtctcggcaacacgctgggctgggcatgggcatggccgcttaaccgccgtattctgtataaccgcgcttccgccgatccgcagggtaacccctgggacccgaaacgtcagctactgaaatgggaaggcggaaaatgggccggatgggatattccggactacagtgccgctgcgccaggcagcgacgtcggaccgtttatcatgcagccggaagggatgggtcgcctgtttgctatcgataagatggcggaagggccgttcccggaacactacgagccgtttgaaacgccgctgggcactaacccgctgcacccgaacgttatctctaaccctgccgcccgtatctttaaagacgatgccgacgcgctgggtaaagcggataagttcccgtatgtcggaaccacttaccgtctgaccgagcacttccactactggaccaagcacgcgttgcttaacgctatcgcccagccggaacagtttgtggaaattggcgagaagctggcgaataagctcggtatcgcgcatggcgataccgtgaaggtctcctcgaaccgcggctatatcaaagccaaagcggtggtgaccaagcgtattcgcacgctgaaagcggacggcaaggatatcgataccatcggtattcctattcactggggctacgaaggcgtggcgaaaaaaggttttatagccaatacgttaacgcctttcgtcggcgatgcgaacacgcaaacgccggagtttaaatccttccttgtgaacgtggaaaaggtgtaacggagacgacctatggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgactgtgtggtggtcggccaggaaccggcctgcgtgaagacctgtccaaccggcgctattcattttggctcgaaagagaatatgaaaacgctggcgggcgagcgggtggcggaactcaaaacccgtggttatgacaatgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatgaaacgacgtgacaccatcgtgcgctatacggcgccggaacgcatcaaccactggatcgtcgccttctgcttcgtgctggcggcggtgagtgggctgggctttttattcccatccttcaactggttgatgcatatcctgggcaccccacaactggcgcgaattctgcacccgtttgtgagcgtggttatgtttgcctcgttcatcatcatgtttttccgttattggcaccacaatctaatcaatcgggatgatatcttttgggcaaagaatattcgtaagatcgtcgtcaacgaggaagtgggtgacaccgggcgttataacttcggtcagaaatgcgtattctgggcggcgattatcttcctggtgctgctgctggtgagcggggtaattatctggcgtccgtactttgcgcctgctttctcaatcccggtgatccgattcgcgttaatgttgcattcttttgccgcagtagcgttaattgtggttatcatggtgcatatctacgccgccctttgggtgaaaggcaccattaccgcgatggtggaaggctgggtaacccggtcgtgggcgaagaaacatcacccacgctggtaccgagaagtccgcaagacaacggaaaaagaaactgaatgagtattcgcataatcccgcaagatgagctggggtcgagcgagaaacgtacggcggatatgattccgccgttattgttcccccgactcaaaaacgtctacaaccgccgcgccgaacgtctgcgcgagctggctgaaaataacccgctgggcgattacctgcgctttgccgcgcttatcgcgcacgcgcaggaagtggtgctgtacgaccatccgctggagatggatctgaccgcacgcattaaagaagcgaacgaccagggcaagccgccgctggatatccacgtgctgccgcgtgataagcactggcaaaaactgctgcattcgttaattgccgagctaaaacccgagatgaacggccccgcgctggcggtgattgagaacctggagaaagcctcagagcaggagctagagcagatggccagcgcgctgtttgcctcggattttgcctccgtcagcagcgataaagccccgtttatctgggccgcgctctccctttactgggcgcaaatggccagcttgattccaggcaaagcccgcgcggaatacggtgaagcgcgccagtattgcccggtatgcggttcgatgccggtctccagcatggtgcaaatcggcaccacgcaggggctgcgttatctgcactgtaacctgtgcgaaaccgaatggcacgtcgtgcgcgtaaaatgcagtaactgcgaacagagccgcgacttacactactggtcgctggaaaatgagcaggctgcggtgaaagccgaaagctgcggcgattgcgggacttacctgaagattctctatcaggaaaaagacccgaaagtggaagcagtggccgacgacctcgcctcgctggtgctggacgcgcgcatggaacaggagggcttcgcccgaagctctatcaacccgttcctgttcccgggggaaggggaataagttttttactcagaccgggcgaagtttgccgtccggtctacaagtgatacggcgtgatcactcccggaatatcggcaaagtcttttgtattgcgcgtcacaagctcacaacgatggacttgtgcagtggccagaatgatcgcatccgggagtttcatgccatactcctgcctgacaatgacgcttcgttccgcgatttcctgtgttacgccaataatattgaacgcacttaatgcaatgcgcgtgcggttttcctgatgatatttcttagcacccaccatcacttccatccatgtgataaggctaatcgcattttgtggcggatacgcttccagcgcatgtttcgcttcaattcgaccgctaaacaggtcgatgaggatattggtatcaaaaagcgcagaccctttgaccattaccattcctcacgaagtttacgttggtattcaacgccatcttcctcacagccttgccagagccccaatgctttcgaaattgtggtctcagcccgatcctgtctttccagatactgctcaacggcctcccgcaagagttctgcacgaggtaggttgcgttgcaccttgagatcgtcaagccgtttaatcacatcgtctgataaatcgagtaaaattctgcccatatccatcccagccatcatactcacatatacctccagtatatcattcgcgcttatttttcaaacaacatacacctgagactgacgagaaaatagttattacgcgaacgatttttatttttgcgagccgctttccagaatcgtacgcagcccaattttcccattttcattcgaaccaaatcgagttataaaactgtatatccatacagataaaggcaatgaaaaatggcactggaaagcgggattgcgcagttagtggaggaatttatcgcggcgggacgcccctcttctcgcgaacagaatattgatgaccggagggcgggctacatcgctagcacgacattggcaggagaaacagaaacccgcgtccaggttgaagatattgaactcgatgccatgacgtttcgcgtggtttcgccgctcaatgccacagggaaattaccctgcatcatttattatcatggtggctgctttgtcagcggcggttttgccactcacgataaccagttaaggcagttagctttttacagccgttgtcgcgtgattgcggcacagtaccgacttgcaccagagcacaccttcccggccgcacataacgatgccgaaaccggagccaatactatctggaaatatgcccagaaactggggatagatcgcgagaacattacgcttgctggtgacagcgcgggtgggcatctggcgctggtcaccgcgctacgcctgaaagccgcccgtcaatggcaacctgcacagctgattctgatctaccccatgctggacgcaaccgccaggtttgcgagctacacctgtaatgggctggattacattatcacgcgtgacacgctgctttcaggctacgagatgtatatgccgcgaaccgatccactgcatcctgaagccagtccgctctggcgtgaggacttcgccggtctgccatccacgcacatcattactgccgaattcgacccactgcgcgatgagggcgaggccctgtatcaacggttccaggaacagggtgtggaatgcacttgccagcgctatctcggcgttatccacgggtttttccaattgggcggagtgagcaagacggcgcgggacgcaatacgcgacgtggcctggcgtgttgtaagtccatcaacaagcaaaatgacctaaaattcaattttgttttcaacttgaaaactggataacgttgcgctaaattgttttcaggttgaaaactttgtaatggaactacattgtgcatgttatcagccgaaaactgttcaatgaagcgatgctcatgtatccaaaccatgagcttgctctcactgagttgctgaatgttctggagaaaaaaacattcactcagcctgaagagatgaagcggtatattccttcgctggataattttaagtacagagataaatggtgggtgattgatgtttctggtaacagcctgagactcatttcctacatagatttcaggttacataagatatttgtgaaacatatcgtttcccatgccgaatatgacaaactgaccgcatattatcggggtaatgaagaatgagaactcatcgtcagatggatgcaaccagcgcaaaaaagatcgttgataccttcagcgatgcggtaaaaagcgtcccactgatgggggaagaccgaaatgacaatgagtatcgcagggcactagcgctagtggagtttctggtcgaccacgacgatcttgaaaacccactatttgaattgctctgtgcccgaatcagtgaatacgaaaaacatgcgccggaattcaaagcactcaaccaacacctggagaaaacgccccctggcgtttcagtattgcgaacgctcatggatcaatacggtctcaaagcagcagatcttgccaacgaacttggttctaaatcgaacgtcagcaacatcttaaatggccgcagagcactaacggttaatcatattaaagcgcttacacaacgctttaaactaccagcggatgccttcatcgagtagttggatatgtccagctactcttcctcattcccgccctcttcatacgggccgaacggtttcgcaggtagtacgatataaatgccttcgaaaattgccccggcggtctcgccgcccaacagttcaacctgcaactggacacgcgcttttttaccccgcgccagcctgtccaaatcaccgcttagcgaccccaaatcagccacggcgtttggctttccgctaatgggtttactgtagcgaatatgggcgtcagcaagaataatcgtcccgcccaggtggcgttcacggagcatcagccagataagtccccatccggtcagcgtcgccagggagaacaggctgccggcaaacaccgtgtgatgcggattttgattaccggtttccggcatcgtggtgataaatttttgcccggtgtactgctgaatgcgcacccccatcttttcactcaatggaatgtgctcataccaggcctgctgaagctgcccgcaccaatcgccgcgatgcaggatatcatccagcgatgctaccggtttaatcatcagaaaatggcggattggcgtggttgtgggcgtagtaatctccccctgattgacaaacccgagtttggcaaagaactcaaccgcatcttcgcgcgcgctgcaggtgacgcgcttaacgccttcctggcgggcgacagactccagggtcatcgccattaatgtccccagccctttatcctgtaccgagggatgtacagccataaaacggatagacgcctcgttatctgcattgatatacaggcggcccactgcaactaagtttccttcttcgtccaccaccatttgatggtgcgccaacgcatcccagccatcccgttccgaccctttcggctggtgcagcggtttacgcagcatctcccagcgaaactggtagtaacgttctaattcttcttctgtttgcggaactcgaaggtgatacatagccgtactctctcttgttatccgcggccacgccggaagctgactcatacctggagccagaatgtcacgggaccgtcattaaccagctcaacctgcatatcggcagcgaagcgtccggtttgcgtgtttatcgcctgctggcggcagcgttcgacaaaatattcataaagcgcctgcgcgcgatccggcgcagccccgccggaaaagcttggccgcataccgcgttcggtatctgccgccagcgtaaactgcgacaccaccagcacgctgccgccagcctgttgtacattcagattcatcttgccgtcaacatcgctgaagatacggtatcccagcacgcgctcgcacagacgattcgctttttgttcgtcatcttctttttcgacacccaataacaccaaaagtcctgggccgattttacccgtcacctcgtcctccacggtgacgctggcacgggttacgcgttgaattaatgcaatcatggttggtcagcttcttcttgttctgcggcttgtttgagttttcggtattccccgagagtgacagttatttctgcgccaagcaagactatacaccaggtccagtatacccagacaaacaggatagggatcactgccagtacgccataaatgagctgatatgacgggaacatggtgatataaagcgcgaaacctttctttccggcctcgaacagcaacgctgcgacaaacgcgccgacaagggcgtcacggttcggtacgcgagttgttgggacaatactgtaaagtaaccagaatgagatccacgagagcagcagcggaaggatgcgcaatacattgtcgatgaccgtattcagatcgctggcccagcgtaaagaaagcagataggagctgatcgccagactggcaccggcgagaagcgggccgagcgtgaggatcatccagtacaccgcaaaagagtacacttttgggcgtgtgcgtttgctgcgccagatagtgtttaaggcgctatcaatggcgtacatcaacagcaatgccgtcacaatcagtccacaggcgcccaccgccgtcattttgttggagttagcgacaaactgctcaatatagcgctgaatcacgtctccggtggctggcataaagttagcaaaaataaaatggcgtaactgaatgctgacatcagaaaacatcggaaaagcagcgaaaagggcaaaaacgacggcaataagcggtactaaggagagtaatgagacataggcgaggtttcccgccagagtcgtcatattatcctcatcgatacgctgccataatagcttgagccaggcccgaacagggcgcgtatggcgtccagctttttggtgaacggtttttagcataacagcttcgcgaaatagtcagggatggtggctttatccttcaccagaatgctggtgatccccaactggttggccccttctatattatcggcattgtcgtcgaaaaagaccgcatcggcagcggaaaaaccttctttctgcaggacgtgctgataaatacgcgcttccggtttacgcattcccaaatcctgcgataaatagatatggtcggcggcagcgcgcacctccgggtattcctccggccagaagtgggtatgcagtcggttagtattggataacaccaccacgcgatgcccctgctcgcgcagtttatgcatgatagcaatcacttcgggccgtaatccgacaaataccgcctgccagccgtgcgcaaattgttcataactgagcgataacgccatttcatgacagaaagcttcagcaaacgcttcgtccgttatctcaccgcgttcatgttggtgaaaagtctcgcccatcgtaaatttttgcttcagcgaagccaacggtactcgactcaggtcgctccacacacctaatacgcggttaaagtcgatatcgacaatcacattacctaaatcaaagatgtagagcatgtcattctccttgctaaccggggatgaataactgtagcgggaaaggagaagtttgactatgtatccctttataaatcaattaacaaaaagacaatagaaacgcagacgatgcccaatatcgcctgcatcacagcgccgttttattggccggataaagcgctgacgcgaccctccggcgcaagggcgcttgtcacgctgaaacggcgtcgtccagcgaaggactcacctgaaccacttcgatttgctgggattgaagtaaattctgtaatgccggaccgggatactcgtccgtaaacagagcggtaatctgtgacacattgccgatctcaaccgccgcaaaagcatggtatttcgtatgatcggcggccagcagaatatgtcgcgagtgagccatcatggttttcactacgctggcttcgttgacatcaaactccagtaacgcgccatcgctctctatcgcgcctacgctggtgacgagatagtccgcccggaaccccgccacaaacgccgccgcggatggcccgataatgccgctattatgcgggcgcagcgtgccgccaggcaccatcacttcaaagcgagggttattataaagaatgtgcgcgacgcgcaggctattggtgataatgcgcagatgattatggttgagcagcgcgcgcgccacctgctcaaccgtcgttccaatcgtgataaatatcgtggagccatccggaatatagtcagccacggcttccgcaatggcttttttctcttgcgtccaggagatctctcgctgctcaaaggcggtattgaccacactggacgctctgccagcgccgccgtgatgacgcgtaatcagcccctgctcgcttaatttacgaatatcgcggcgaaccgtctgggtagagacctccaacaaactggctaactcatcgatattcatatagccgcgctcatcaataagcattaacagccgatcgtgtcgcggattaccggtcagttcggtaagactcatgagcattcctctaaaagcttcctactgctcatattatacaaaaagtgacaagaaagatcgggtttgctcacaatcagggatacccgcccggccacccgggcgcgtacacttcagcgcggcaacgccgctggcgaatctgacagcctcttcgatagcgtatccgcttgccaggccaaatgccagtgcgccatgaaaaacatcgcccgcgccggtagtatccaccacctccacggtaaaacccggttggtggcgtaccgccgctttttccaaccagttgcagccttcgctgcctcgcgtgacatagacatgtccatttgtgagcatttgtgctttttttagcgcatcaatggcttcgctcatccccgtcaggcgtgccagccccggctcggagaaggcggcgtggtcgcttaacgccaccagctcgctaatatcctgcggcgtaatatcgccatcaagaacagtcatgacgccagcctgacgcgccagcgtaaacgcctgttttgcgccgtcatgccagcgcacatccgccaacaccacatcccactgcgaaaaatcgatgtcgttaagccagtcggcgtcaggtaataaatccgggctgggataattaacgataatccgctctcctttggcatccaccataatcgctgactgcgacgacatggcctgcgtgtagcggcgggtatagcgggtatttacccccagggattccagttccgccagcaggctgtttccggtgtcgtcatcgcccacacggccaataaagtccacctgcgcgcccaatttcgccgcagccacggcagcggtcgccgcaggcccgccgcccacttccgtatagcgcttcgccacatatttgcccccttctgttggtaatccttccacgtaatagatgcgatccatcacggtaatacctacacaagcaatacgaaccatggtcattcctcaagcattttcgatgtgctcattttaatttcacgaaatgtttaaaaagtgacggctgtcaattttttgaccataaattacaaatacgatcacaaacagacagaaaaggctcattaatgacaaaaaatgacaccaccgtgttcaggagaacgatatggcagttatagcatttatcgggttgggacagatgggctcccctatggcgagcaatctgctaaagcagggccatcaactcagcgtcttcgatattaatcccgacgccgtacagcgtctggtagacaaaggcgcgcaacctgcaagcagcccggctcagacaaccatcggcgctgaatttgttatcaccatgctcccgaacggcgatctggttcgttccgttttgtttggcgagcaaggcgtttgtgaaactctttcccgtgaagcgctggtcattgatatgtccactattcatccgttgcaaaccgataagctgattgccgacatgcagagcaaagggttcagcatgatggatgtgccggtaggccggacatccgacaacgcgattaccggcacattgttgttgctggcaggcggtacgacggagcaagtagagcgcgctacccctgttctgatggcgatgggtaatgagctggtcaacaccggcggcccgggaatgggtattcgcgtaaaactgatcaacaactacatgagtattgcgctaaatgcgctctccgccgaagccgccgtgctgtgtgaagcgctggggctttccttcgacgtggctttaaaagtgatgagcggcactgccgcaggcaaagggcatttcaccaccacctggccgaataaagtgatgaaaggggatctgtctcccgccttcatgatcgatctggcgcacaaagatcttggcatcgcgttggatgtcgccaatcaactgcacgtaccgatgccgctcggcgccgcctcccgtgaagtttataacctggcgcgggccgcaggccgcggtcgggaagactggagcgccatcctggaacaggtgcgcatcagcgccgggctgactgccaacgtaaaaaagtaacgactgtataaaggaaaattgaatgaacaactacaccatcaaagacattacgcgagcgtccggcgggtttgccatgctggctgtcgatcagcgcgaggcgatgcgtttaatgtttgctgctgctggtgcgaaaacacccgttgccgatagcgtgctgacggatttcaaagtgaatgcggcgaaaattctttccccgtatgcctctgccgttctgctggatcagcagttctgttatcgccaggccgtagaacaaaacgcggtcgctaaaagctgcgccatgatcgtcgcggcggatgatttcatcccaggcaacggtattcccgttgataacgtggtcattgataaaaaaattaatgcgcaggcggtaaaacgggatggcgcgaaagccttaaaactgttggtgctgtggcgcagcgatgaagacgcgcagcagcgtctggatatggttaaagaattcaatgaattatgtcactccaatggtttgctgagcattatcgaaccggttgtacgtccgccgcgctgcggcgacaagttcgatcgcgagcaggcgattatcgatgcggccaaagagctgggcgacagcggcgccgatctttacaaagttgaaatgccgctctacggcaaaggcgcgcgttccgatcttcttaccgcctcacaacgcctgaatgggcatatcaatatgccgtgggtcatcctctcttccggtgtggacgaaaaactgttccctcgcgcagtcagggtcgccatggaagctggcgcatccgggttcctggcgggacgcgcggtctggtcatcagtgattagtttaccggataccgagctgatgctacgtgatgtttccgcgcctaaattgcaacgtctgggcgagatcgtcgatgaaatgatggcaaaacgtcgttaatacgaggatgaaagaatgaaatggtttaacacgttgagccacaaccgctggctggagcaggaaaccgaccgcatctttaatttcggtaaaaacgccgcggtgccgacaggcttcggctggctgggaaataaagggcaaatcaaagaagagatgggcacccatctttggatcacggcgcgtatgctgcacgtttattccgtggcggcgtcgatgggccgaccgggcgcttatgatctggtcgatcacggcatcaaagccctgaacggcgcgctgcgcgataaaaaatacggcggctggtatgcctgcgttaacgatcagggcgtggtggatgcctctaaacagggttatcaacacttcttcgccttgctgggtgcggccagcgccgtcacgaccggacaccctgaagccagaaaattgctggattacaccatagaaatgattgagaaatacttctggagtgaagaagagcagatgtgccttgagtcctgggacgaagcctttagccagacggaagattaccgtggcggtaacgccaatatgcacgccgtcgaagcgttcctgattgtttatgacgttacccatgacaaaaaatggctggatcgcgctatcagaatcgcatcagtcattattcatgatgtagccagaaataatcattaccgtgttaatgaacatttcgattcacagtggaaccctatccgcgactacaacaaagataatcctgcccaccgtttccgcgcctacggcggtacgccaggtcactggattgagtggggccgtctgatgctccatctccatgctgcgctggaggcccgcttcgaaacgccccccgcctggctgctggaggatgcgaaaggtctgttccatgccactatccgcgacgcctgggcgccagatggcgcagacggttttgtctactcagtcgactgggacggtaaacctatcgtacgtgaacgcgtgcgctggccgattgtggaagcgatgggtacggcctacgccctctacaccctgacgggcgatagccagtatgaagagtggtatcagaaatggtgggactactgcattaagtacctgatggactatgaaaatggttcctggtggcaagagctggacgccgataacaaagtgaccaccaaagtgtgggacggcaagtaagatatttaccatctgctgcactgcctggtcattcctcgtctgccactggcgccgggcctggctccggcggtcgcggcgggtctcctggatatcaacgcgaaataggtcatgaggatggcagccatgcacagcggtggaaaaactattcagcttaatgcgggccattaccaggcgaaaatcgtcacggttggcgcaggtctggcggaactgactcatcatggacgtcatgtggtcatcccgcataaaccggaagaaatacccatggcgcatctggggaaggtattgattccctggccaaatcgcgtgacaaatggctgctactcctataacggcaaagttttccagcttgccgttaacgacccggtttcgcagaccgccattcacggtctgttagcctggcgagactggcagattaattatcagtcggcgacggaagcgtcgctaacgatttttctgccgccctcttacggctatccctttgcgttgatatcggaagtgatttatcggttagatgccgccagtgggctgcacgtattgattcgtacgcaaaacattggcgatgaatcagccccttatggcgcgggcgcacatccttatttgacttgtaatctgcaaagcatcgatagctgtgtattaacactgcctgcaagcgaagaattgcccgcaggcaggaatttttccgcatcatgcctgctcggcgaaacgcgccttgatcatgcggttaagaccgcgactgccccggcggagtgggaggtcagacttaccagcccaacgcagaacatgtctacatttttacgcagcaagcaaccctggctacagatctataccggcgaaaaactcagccgaaaggtctcgcggtagagcctatgagctgcccgcccgatgcatttaattccgggatcgcactgattcatcttgccccaaaagcgatccatcaactgcatttttccatcggctgcgactagcccaaatggattaccgaattaccctacattcacggagattacaatgaattctctaccacaacggtcaaccgattttgaactgacaacatcacaggatggttttgcgcttagctggcaacagcgcctgattttacgccacagcgccgaaaacccctgtctgtggattggcgcgggcgttgccgacattgacatgtttcgcggcaacttcagcatcaaagacaaacttaacgagaagattgcattaacggaggccaccgtcagcgagctacccgacggctggctggtacaattcagccgtggcgcaacaattagcgccacccttcgcatctccgccgatgaggcgggacgcctgacgttggatctgcaaaacgacgacctgcaccataaccgtatctggttacgcctcgcagctaatccagacgaccatatctacggctgcggcgaacagttctcttatttcgatttgcgcggcaagccgttcccgctgtggaccagcgaacagggcgttggccgtaataaaaccagctatgtcacctggcaggcagactgtaaagagaacgccggcggcgactattactggaccttcttcccgcaaccgacctttgtcagcacgcagaagtattactgccacgtcgataatagctgctatatgaatttcgacttcagcgcgccggagtatcacgaactggcgctgtgggaagataaaactacgctgcgttttgagtgtgccgacacctacatcgccctgctggaaaaactgactgcgctgttaggtcgccagccggagctgccggactgggtttacgacggcgtcacgctcggcattcagggcggtacggaagtttgtcagcaaaaactggataccatgcgcaacgcaggcgtaaaagtgaacgatatttgggcgcaggactggtccggtatccgcatgacctcctttggcaagcgcgtgatgtggaactggaagtggaatagcgacaactatccacagctggatagccggatcaaacagtggaaagaagaaggcgtccagttcctctcttatatcaacccatacgtcgccagtgataaagacctctgcgctgaggcggcgagacacggctatctggcgaaagacgccacgggcggcgactatctggtcgagtttggcgaattctatggcggcgtggtcgatctgactaatcctgaagcttacgactggttcaaagatgtcatcaaaaagaacatgatcgcgctcggctgcagcggctggatggcggatttcggcgaatatctgccgaccgacacgtatctgcacaacggcgtcagcgcagagatcatgcataacgcctggcccgcactgtgggcgaagtgtaactacgaagcgctacaggagaccggcaagctcggcgagatcctgttctttatgcgtgcgggttacaccggcagtcagaaatattccaccatgatgtgggcaggcgaccagaacgttgactggagtcttgatgatggtctggcctctgtcgtgcctgctgcattgtcgctggcgatgaccggccatggtctgcatcacagcgatatcggcggctacaccaccctgtttgacatgaagcgcagcaaagagttgctgctgcgctggtgcgatttcagcgcctttacgccgatgatgcgcacccatgaaggcaaccgccccggcaataactggcagttcgacggcgacgcggaaactattgcccactttgcccgcatgaccaccgtctttaccacgctgaaaccgtatctcaagcaggcgatggcgcaaaacgcggctaccggtctgccggtcatgcgtccgctattcctgcactacgagaacgatgccgctacctacaccctgaaatatcaatatctgctcggtcaggatctgctggtcgcgccggttcacgagcaggggcgttgcgattggacgctgtacctgccggaagatcactgggtgaatatctggaccggcgaagctcaccacggcggtgaaattaccgtggatgcgccgattggcaagccgccggtcttctatcgcgcgaagagcgagtgggctttactttttgcttctttacggaatatctaatacggctcgcccgcagggaaacctgcgggcagatggagaagaataatgagtcaaacatcatcgaatccggcaaccatacgcttgccgtttaaagaaaaacttgcctatggactgggggatttaggttccaatatcctgttagatatcgggaccctctatttactcaaattttataccgatgtgctgggtttaccagggacttacggcgggatcattttcctgatcgccaaattttttaccgcatttaccgatatgggtaccggcattatgctcgactcgcggcgtaaaattggtccgaagggcaaattccgcccgttcgtgctttacgcggcatttccggtaacgctactggcgattgctaactttgtcggcacaccgtttgaggtgacgggaaaaaccgtcgtcgcaacgatgctgtttatgctgtatgggctggttttcagcatgatgaactgctcgtatggcgcgatggtgcccgcgattaccaagaacccggatgaacgcgcctcgcttgccgcgtggcgtcagggcggcgccactctcggcctgctgctgtgtaccgttggctttgtgccggtcatgaacctgatcgaaggcaatgcccaactcagctatattttcgccgccacgctattttcattgtttggcctgctatttatgtggctgtgctacgccggcgttaaagagcgctacgttgaagtgaaacctgtcgatagcgcgcaaaagcctggattattgcagtcgttccgcgccatcgccggtaaccgcccgctgtttattctgtgtatcgccaacctttgtactctcggcgccttcaacgtcaaactggcgattcaagtttattacacacagtacgttcttaacgacccgatcctcctctcctggatgggcttctttagcatgggctgtatttttatcggcgtctttttgatgcccggcgcagtcaggcgttttggcaagaagaaagtctatatcggcgggctgttaatatgggtggcgggcgatctgctcaactacttctttggcggcggctcggtcagttttgtcgccttctcctgcctggcgttcttcggttccgccttcgtcaacagcctgaactgggcgctggtttccgacacggtggagtacggtgaatggcgcaccggcgtccgctcggaagggacggtttacaccggcttcacgttcttccgtaaggtctcccaggcgctggcagggttcttccccggctggatgctgacgcaaatcggttatatcccgaatgtggtgcaatcggcaggcaccgtcgaaggcctacgccagttgatctttatatatccttgcgtgctggcggtcatcaccattattgcgatgggctgtttctacaacctcaacgagaagatgtacgtgcgaattgtggaagagattgaggcccggaaacatacggtttaacaacaataaaatataacgccctgcggggcgttttgagaggcgattatgtctaatcatgatccgctaacgctaaagttgagcctgcgggaaaaatgcgcctatggcgtgggcgatttcggctcaaatctgatgctgtgtatcggtacgctgtatctactgaagttttataccgatgaactcgggatgcctgcatattacggtggaattatctttctggtggcgaaattcttcactgcttttaccgatatgctcaccggcgtattgctggattcacgccgtaatattggcgcaaaaggaaagtttcggccttttattctgtatgcgtcatttccggtggctctggttgctactgcgcaattctttgccactcactttactttacccgttaaaacagccttcgcgacggtgctgtttatgttgttcggtctgttctacagcctgatgaactgctcatacggcgcgatggtacccgctattaccaaaaatccgcatgagcgggcccagctcgccgcatggcgacaaggcggcgctaccattggccttcttctttgtaccgtaggttttatgcccattcaggcgctgtttacccgttccccttcgctgggttatctggttgcagcagtcattttttcggtctgcgggctgttcagcatgtggtggtgctttagcggggtgaaagaacggtatatcgaaaccgtacctgacacgcataaacccagcatattgaagtccttctgcgcgatttttcgtaatccgccgctgctggtgctctgcgttgccaatttgtgcacgctggctgcctttaatattaagctggccattcaggtttattacactcagtacgtgctgaacgatattcatttgttgtcatggatgggttttttcagcatgggctgtatcctgattggcgtcttattagtacctgatgcggtaaaacgcttcgggaaaaaacaggtttatcttggtggtctgatactgtgggccgttggcgatatcctgaattttatctggggcggaacgtcattcctgtttgttattttctcttgtattgccttcttcggtaccgctttcgtcaacagcctgaactgggcgctggttccggatacggttgactacggcgaatggaaaacgggtattcgcgctgaaggctcggtgtatacgggttataccttttcccgcaaaatttccgctgcgcttgctggctttttgccaggtattatgctgacgcaaatcggttatatccccaacatagctcaaagtgacaccacgttgcttggtttgcgtcagctcatttttttatggccttgtggtcttgccattatcgcagcactaacgatgggctttttttataagctcaatgaacaacgtttcgcttttattatcgaggaaattgcccaacgaaagaaaacaggcaatcaaattgtcgcaactaataataaacaaagtatttctactgtaaataattaaacgacgcttgccgctttattcatcccgatggatggcggcttccctatatttgaaaaatggatttattatgaaatctctgaatactctagtgatattaacttcagtaatatccacctctgtttttgctggcgcttatgtagaaaaccgtgaggcctataacctggcgtctgaccaaatggagtttatgctgcgcgtcggctataactccgatatgggggccggaattatgttgaccaatacctatacgctacagcgtgatgatgaattaaagcacggttataatgagattgagggctggtatccgttatttaaacctacagataaattaaccatccagccaggcgggttaataaacgacaaaagcattggttccggcggcgccgtctatctggatattaactataaatttaccccgtggtttaatcttacggtacgtaaccgatataatcacaataattatagttcaaccgatttgaatggcgaactggataataatgacagctatgaaatcggtaactattggaattttatcattaccgataaattttcttatacctttgaaccacactatttttataacgttaatgattttaatagtagtaatggtacgaagcatcattgggaaatcactaataccttccgttatcgtatcaatgaacactggttgccctactttgaattacgctggttagatcgtaacgtgggcctctaccatagagagcaaaaccagattcgtatcggggcgaagtatttcttctgatattatcgcctctattttccgaatctgcatcacagcgggtagttgttctgcccgctcattcatcctgaatcagactcccgatatcccgcctctaagcgccatgataatattcgcaaagcgttttaccatattcatgcttatagagaagggaaacaaatgaataagcgattcaatattgattgggacaatgaattaacccaggaacagctcattaatttaattttaaccgatgaagatctgccaaagcttcgctcactgaccattggtaactggggtgattgttgggaagacgaaacctgccagcctattattgatatgattgtggagaacgccccccgtttttctcacctggaatcactgtttatcggtgatatggagagcgaagactgcgagatctcctggattaaacaaggtgactattccaggctctatgcggcgttacccaatctgaaggaactgattattaaaggcgcgtcggatctgcgactgggcgctatacatcatgagaaactggagcacctggaaatcatttccggcggcatcccttctaacgtacttgccgaactacaaaatgcgcagctccctgcattaaaaacgctgaagctcttcctgggcgtagaggaatacggttttgacggttcgctggataacgtgatggcgctggtatcgaaagatcttttccctcagctcaaccatctggggttgatgaacagtgaagagcaggatgatatcgcccgccgggtgctggaaagtaatatcctgccgcagcttaacgtgctggaactctcatgcggtaccttaactgatagcggcgcagaggcgctgctggagcataaagaccgaattgcgcatctggaaacactcgatctccaccaccactatttgacgccggagatgcaggaaaagctaaaagccgcgctgccgataccgctgaatctttcagaagcgctggagcctgatgattacgatggcgatatttatatgaatgcgatgtacaccgagtgattgtgtaggggaatgtgcacattcccctacacaccgataaagggatttattgtgattacgctcattggcccccatcagagcaagcgcacgcattattttatgcaggctgccgccatacttggagaatccgtcacggcgctgactcatccgcaagcgctggacgcttcgctgacctctggcatcgttaaaatcgacccgccagtacacaatgaaactaacatccgcaaaataaacgcgatcggtctggactatatccattttttgcagaacatggcagcgcgtcctggcatcacctagcttaaccatccggcgggcctcattcacctgttggataaaaaacgctgcaagcggcgcttactggaacacggcatccccacgccgccgttggtagcggaagacgtaaaaagttttgcacagctcaccgccatcatggaggaaaaaagggtcgccagcgtgttcattaagccctcgctgggttttggcgcggcgggcgttatcgctttgcgccgtcatcctgacggcgcaaagcaggtgctttacagcgcgattgccatatcagggcaacagctatttaacagcaaaaaaatccaacagtatcgtcagaaagaagatatccagctcattattgatggcgttcttcagcaggaaaacctcgtcgaacagtggctgcccaaagccagcgtaaagcataaaacctatgatttacgcatcgtctgtctggatggcgaaattatctggcgagtggtcagaacctcctcgcagcccattactaacttacacctgcaaaaccaggcttaccgcttcgaaagtctggagttatctgccgcaaaagtggctgagatcgatacgctctgtcaaaatgccatgcggctttttcctggcattcgcttagcgggtattgatgttttacttaccaccagcctgacgccgtatattattgaaattaatggccagggtgatttgatttatcaggatgcgcagcagaacaatctaatttatcaggcgcaaatccgggccatgaggaagcaaaatgtataattcaatggatgaagtccccgtctcgctacacgcgtcgattgacacaggcgatggcgaattcgatatgaatgcgctaattagtaataacgctcatattctttttattgtactggactcgttacgctacgatattgcgcttcaggaacaaaccgccggaaatacgcccaaccttaatcattatggacaatggacgaaatgcgaggcggccggtaattttacctggccttcgcatcacgccatgttttcaggttttatgccaaaacctattgatgataccgttaatcagaccatgctgcttttcccaaaagatatcggacttggtcgtaaaggcccgaaaaatgcatttgcctttgatgacgcaacatggataaaaagtctggaaaataaaggctaccagaccatctgtattggcggcgtctctttctttaataaccgctccggcatgggaaaagtgttcccgtcgatgtttaaagagagttactggcatccacgctttgcctgtacggttaaagaaagtatggataaccagatccattatatccagaaaatcatggccgaacgtgctggcagccaaccggtcatgatgtatatcaatatcgatacgattcattaccctaaccatttttacgttgagggcgcggcccctggcgataccgtagagacccatgccgccgcgctacgctatatcgacgcccgcatcgacggattactgaacattttccgccaaaccggcggcgaaacgttcgttattgtctgttccgatcacggtacctgctatggcgaagacgggaaatatttccatagttttaatcatccgatcgttaataccgttccttatatgcatttcttattgagcggtaatcattaatatgaataacaatgatatttatcgtcagtatatgtacagttatccgcataagacggcttatcgggagctggagaacgtcagctttagcaaagtaaaaccgcgcatttacgagcacgacacacatctgtatgttcatatgccgttttgtcaaagtcgctgcgggttctgtaatttatttacctgcactggcgcagataatacgttcattgatagctatatcgacgcgattattacctagggccgacaaatggcgctggcgcccgtccactgggcaagcttcaccgtaggcggcggcacacctctgctattaaacattgcgcaattagaaaagttatttttttccgtctttgatgtgctcaatgttgactggaatatttataaaacaattgaaacttcccctacggataccacggcagaaaaagtagcgctattaaacgccttttccgttaatcgcgtcagtattggcgtacaaagttttcatgatagcgagttacatacgctgcatcgccgccacaataccgccagcgcgcaccaggcgttggaatggctaaaggcaggtcattttccatcactcaatattgatattatttacggcattcccggccagactcacgcaagcctgacggaatcgttacatcaggcgctcgtttatcaaccggaagagctgtttctttatccgctttataatatgcctcgccaggaaaatatgcatagctactacgttttagcccgcgatcttttacgcaacgcgggctacacccaaacgtccatgcgccgtttcgtccttaatccagcgccatccgccgcggcggaaagctgcggatttgaaaactcactggcgctcggcgcggacggcagaagttatcttggcaatctgcattactgttcaccgtggccgtcgaacctgcaaacatcacgaaaaatcattcaggcgtttatcgacagcccggacaaaaccgtcattaatcacggttatctgctcccccctgatgaaatgaaacgccgctttatcattaaaaatctatttttctggcaaggactttctcttagcgattatcagcaatattttaccagcgatgcgctaagggatttccccgacctggaacgctttatacggcagggctactgttatcagaatggcagtcgcctccggctaacggagaccggtatggcattatccgattgccttgctcctgtgttcgtttcgcctgaggtgatgctacgggagaatcggcagagatgagcatccccgccctgcgcgatattcatacgctgttttatcgcggctatcttaagtcgtgtaattatcattgcggctattgcccgttccataaacacgcccgcaacgataaaaaacgcgacgaagccgcgctatggcgcatggttgaccatttgcctcttttaggtacgccgttgaatgtgatgattacgccttatggcgaggcgctacgcttgcgttattacatggcggcgctggcagacattagccgctatcctcatgttcaggcggtcggcatacaaactaacgcctctttttcgttaatgtcattgctggagtcatttcgtgctggcggcggagatatctcaaagcttcggttatggtgttcttttcatccctcacaaattaccgctgaacgctttctccagcagtgtttagcgctctctgccgccggaataacctggtgcgcgggggctgtcgccagtatgaaagatatcgaccagtttcgttggctacgccagcggttgcctgaccagaattatttttggtttaacgccaacgagtgtgccaatacccggcataccgttgaggaaaccatcgccttcagcgaactcgatccgctgtatgtggttgaaacgcagcagtggccagcgcagctggatatctgtaccgcaggaagaaaaagtatttttatgaacgcagaaggcgatctttttgcttgtcatatcagcaaaattaaaatgggtaatttatatcagcaacggctcaattctcctgcctgccaggcaaaacaatgccactgttttctcgcttatcagcaccgtctcgatattccattgctgaatcacctggatgcctcacgctgttttaggatcgggcgctcatgcgatatcgtttaatcgcttttgatcttgatggaacgctgctaaaccgtaataaacaaattctgccagagtcgctaaccgctatccgtcagatgcaggacatgggctgccgaataatgcttgtcaccggtcgctctcatcgtgaagcctatgcgtattatcaaacgctggcgctcaccgaaccgatgatctgttgtaacggaagttatatttatcaaccggctcaacagcagatccttgatccgctgccgctgacgcacttacaaacggaaaaaatactggcgcgggtatatccgcttaaaccgacaattcgtgctgatgataaaataatctttcaggctgatgagctaagcagtagggagaatatttggcaaatcagcgtcgttcatcggcacataaaacaactacaaaatattgctgagtttatacagcatgaattacagctaagctgtacctggtcctggcatcatcaactggatattctccagaaggggtgtagcaaaggacaaagcctcgccagatatgcacagcaacagcatatcgcaatgcgcgaagtgatggcgtttggcgataatgataacgatgcggaaatgctacgtttagccggattgggtgtcgcgatggggaatgccagcgctcgggcaaaggtgtatgcggatagcgtcattggtcggcataatacgccaacgattgctgattttttgacaaccttatccctttctcaacgtgaataaaaaaaccccgccgagttttcatttcggcagggtttttatccgtaagaacgttaattactcttctttctgaccacggttcgcacggcggcgatcgttttccgtcaggtgacgtttacggatacggatagaggttggagtgacttctaccagttcgtcgtcatcaatgaactccagcgcttgctcaagactcattttaattggcggaaccagaatcaccgcttcatccgtaccggacgcacgcatgttggtcagtttcttaccggtcaggcagtttaccgtcaggtcgttggagcgactgtgaataccaataatctggccttcgtaaacttccgcgccgtgacccaggaacagcttaccgcgatcctgcaaaccgaacagcgcaaacgccaccgctttaccctgaccgttggagatcagtacgccgttctgacgctggcccacttcacccggacgaatatcgtcgtaatggctgaaggtggagtacagcagacccgtaccggaagtcatggtcatgaattctgaacggaaaccaatcagcccgcggcttgggatcacgtagtcgagacgtacgcggcctttaccgtccggattcatgtttttcagatcgcctttacgctcgcccagcgcctgcatgacagacccctggtgctgctcttcgacgtccagcgtcacgttttcgtacggctcttgtttacgaccgtcgatttcacggaagataactttcggacgggaaaccgccagttcgaaaccttcacgacgcatgttttcaatcagcacggacaggtgcagttcgccacgaccggatacacggaacgcatccgcatcttcggtttcttcaacgcgcagcgccacgttatgcaccagctctttgttcagacggtcaagaatctgacgagaagtcacaaacttaccttctttaccgcagaacgacgaggtgttaacgcagaagaacatagacacggtcggctcatcaacggacagcgccggcagcgcttcaacgttctgcgggtcgcagatggtgtcggaaatgttcagctcgcccagaccggtgatcgcaatgatatcgcccgcttcggcgatatcgctgtcgatacgctccagacccagatgcgtcagcaccttacctactttcgcgttacgggttttcccttcactatcgatgatagtgacctgctggttcggcttcactttgccgcgtttgatacggccaatgccgataacgccaacgtagttgttgtagtccagctgggagatctgcatctgcaacggaccatcgaggtcaacgtccggcgccggaacatgatcaacgatcgcctgatacagcggggtcatgtcttccgccatatcttcgtggtccagacccgcgataccgttcagcgccgaagcgtagatgatcgggaagtccagctgttcgtcggtcgcgtcgaggttaacaaacaggtcgaatacctggtcgacaacccagtcagggcgcgcgccaggacggtcaaccttgttgataaccacaatgggtttcaggccatgagcaaaggcttttttggtcacgaagcgcgtttgcggcatcgggccgtcaaatgcgtcaaccaccagcagcacagagtcaaccatggacatgacgcgctctacttcaccaccgaagtcagcgtgcccgggagtatcaacgatgttgatacgataatcattccatttaatagcggtgtttttagcgaggatagtaataccacgctctttctccaaatcgttggagtccatcactcgctcttgagtttcggcacgcgcgtcgaacgtaccggattgctggagcagcttatcaaccagggtagttttaccatggtcaacgtgcgcgatgatggcgatgttacgcaaattttcgatcacaactttgcctcaggcattagaaatagcgcgttattgtacacggattaatcgcactacaaaacaggatcacaaacatcctccgcaaacaagtattgcagagtctctttgtgatcgctttcacggagcgttaaaagggtggcttgcgttctattgcaccaatgtggtgcttaatgttcacattgaagcactattttggtgcaacatagtcaccgtggtgcagcccttttgcacgatggtgcgcatgataacgccttttgggggcaatgtgaaagttggcacagatttcgctttatatttttacggcgacacggccagcagaattgaagatctcgttaccacgacgaccgaccatgaccaatccgggagagtacaagtatgtccgctgaacacgttttgacgatgctgaacgaacacgaagtgaagtttgtcgatctgcgcttcaccgataccaaaggcaaagaacagcacgtcacgattcctgctcatcaggtaaatgccgaattctttgaagaaggcaaaatgtttgacggctcctctatcggcggctggaaaggcattaacgaatccgacatggtgctgatgcccgatgcgtccactgcggttatcgacccgttcttcgcggactctaccctgattatccgttgcgacatcctggagcctggcactctgcaaggttatgaccgtgacccacgttccatcgcaaaacgtgcggaagactacctgcgcgcgaccggtatcgccgataccgtcctgtttgggccggaacctgaattcttcctgttcgacgacatccgcttcggcgcatctatctccggctcacatgtggcgattgacgatattgaaggcgcctggaactcctctaccaaatacgaaggcggcaacaaaggccatcgcccgggcgtgaaaggcggttatttcccggttccgccagttgactccgcgcaggatatccgttctgaaatgtgtctggtcatggagcagatgggcctggttgttgaagcgcaccaccacgaagtagcgaccgcaggtcagaacgaagtggcgacccgctttaacaccatgaccaaaaaagccgacgaaattcagatttacaaatatgtcgtgcataacgtggctcaccgcttcggtaagaccgcgacctttatgccaaaaccgatgttcggcgataacggttccggtatgcactgccacatgtcgctggcgaagaacggcaccaacctgttctctggcgacaaatatgccggtctgtctgagcaggcgctgtactacatcggcggcgtcatcaaacacgccaaagccatcaacgccctggcgaacccgaccaccaactcctacaagcgtctggtcccgggttacgaagcgccggtgatgctggcctactccgcccgtaaccgttccgcctccatccgtattccggtggtggcgtctccgaaagcgcgccgtatcgaagttcgcttcccggacccggcggctaacccgtatctgtgctttgccgccctgctgatggccggtctggacgggattaagaataagattcacccgggcgaagccatggacaaaaacctgtatgacctgccgccggaagaagcgaaagagatcccacaggtagcaggttctctggaagaagcgctgaacgcgctggacctggaccgcgagttcctgaaagcaggcggcgtgttcacggatgaagcgatcgatgcgtatattgcgctgcgtcgcgaagaagatgaccgcgtgcgtatgaccccgcacccggtagagtttgagctgtactacagcgtttaatcgtatattaaaaatccgacgaatttcgcgttgctgcaaggcggcaactgagcacatccccgggagcatagatagcgatgtgaccggggtaagcgaaggcagccaacgcagcagcagcgtgaaaggcgtcaggagtttttgagttgccgtggaaactttcagcccatcccaggatgggcttttttctccaccaacaatctgatctcacgcgctttttagtggtaaaaagctataatgcactaaaatggtgcaaccttttccaggagactgctgaatggcaagcggcatacagcccgatgctgggcagatcctcaattcgttaatcaacagcgtgctggtggtcgacgacgcgctggcaatccattacgccaaccctgccgcgcagcagttgctcgcgcaaagctcacgcaaactgttcgggacgccgttacctgaactgttgagctatttttcgttaaacattgacctgatgcgcgaaagtttagcggcaggacaaggctttaccgataacgaagtgacgctggtgattgatagtcgctcgcatattctctctttgaccgcccaacgtctgcccgacgattttatactgctcgaaatggcgccgatggataaccagcgtcgtctgagtcaggagcagttgcagcacgcgcagcaaatcgccgcccgcgatctggtgcgcggtctggcgcacgaaatcaaaaatccgctcggcggcctgcgcggcgcggcgcagctactcagcaaggcgctgcccgacccggcgctaacggaatataccaaagtcatcattgaacaggccgacaggctacgcaaccttgtcgatcgtttgctggggccgcagcacccgggaatgcacattaccgagagcatacataaagtcgcggagcgcgtggtggcgctggtgtcgatggaactgccggataatgtccggcttatccgcgattacgaccccagtctgccagaactgccgcacgacccggaacaaattgagcaagtactgctgaatattgtccgcaatgccttgcaggcgctggggccggaaggcggcgaaattacgctgcgtacccgtaccgccttccagttaacgctgcatggcgaacgctatcgcctggcggcgcgtatagacgttgaagacaatgggccgggcattcctccccatttacaggatacgctgttctacccgatggtcagcggtcgcgaaggcggcaccgggcttgggttatctatcgcccgcaatcttatcgatcaacacgccggcaaaattgaatttaccagttggccggggcataccgagttttcggtttacctgccgattcggaaatagaggtgtttatgcaacgaggaatagtctgggtcgtcgatgatgatagttccatccgttgggtgcttgaacgtgctctcgccggggcagggttgacctgtatcacctttgagaatggtaatgaagtactggctgcgctggccagtaaaacgccggacgtcttgctgtcggatatccgaatgccaggaatggacgggctggcgctattaaagcagattaaacaacgtcatccgatgcttccggtcatcattatgaccgcgcattccgatttagatgccgccgtgagcgcttatcagcagggggcgtttgattatctgcctaaaccgtttgatattgatgaagccgtcgctctggtcgagcgagcgattagccactatcaggagcagcagcagccgcgtaatatcgaggttaacggcccgacaacagacatgataggcgaagcgcccgccatgcaggatgtgtttcgcattattggtcggctgtcgcgttcttcgattagcgtgctgattaacggcgaatcaggaaccggtaaagaactggtcgcccatgcgctacatcgccatagcccacgcgccaaagcgccgtttatcgcgctcaatatggcggccatcccgaaagatttgattgaatccgaattgtttggccatgagaaaggcgcttttaccggggcgaataccatccggcagggccgtttcgagcaggctgacggcggtacgctgtttctggacgaaattggcgatatgccgctggatgtccagactcgtctgttacgcgtgctggctgacggacagttctaccgtgtgggcgggtacgcgccggtaaaagtggatgtgcgcattattgccgccacccaccagaacctcgaacgacgcgttcaggaagggaaattccgtgaagacctgttccaccgcctgaacgtgattcgtatccatctcccgccgttgcgcgagcgccgtgaggatattccgcgcctggcgcgccattttttgcaggtcgccgcccgtgaattaggcgtggaagccaaattattacatccggaaaccgaaacggcgttaacgcgcctggcatggcctggtaacgtgcgtcagttagaaaatacctgccgctggctcaccgtcatggccgccggacaggaggtattgacccaggatttaccgggcgaactgtttgaagcctcggcgccggatagcccgtcccacctgccgccggatagctgggctacattactggcgcaatgggcggatcgcgccttgcgatccggtcatcaaaacctgctttctgaagcgcagccagaactggaaagaacgctactgaccacggcgttacgccatacgcagggtcataaacaggaagccgccaagctgctcggttggggtcgaaacaccctaacgcggaagttgaaagagctgggaatggagtaaacattatccgcgagtgtaaagattaataattgagcgcaaaacgctgctattttgcgctttactgttccgatgagttcagtatgatcatgcccggcaaacggggggattcattatgttagaatctattattaatctggtatcgagtggagcggtcgacagccacacgccacaaactgcgctagccgccgtgttgtgtgccgcgctggtgggactgttcagctgacaatgtgccggatggcgctaatgcttatccggcctacaggttgtcgcaacgtgtaggcccggtaagcgcagcgccaccgggcaacccggctaaatgacgcgcgagaactgctgcatccgcgctttctggcgcagatacgcgtcaaagcacatgcagatattgcggatcagcaaacgacctttcgccgtcacctgaattcccttctcgctaatatccaccagcccatctttcgccagcggcgacagtaactgcaaatcttcggcaaaatattcagcgaaatgcaaaccccactgctgttcgacagcgttaaaatccaggcggaagttacaaatcagcgccttgataacatcgcgacgaatgcaatcatcacgggtcagcgtaataccacgccatagcgcattgccccgctcatccacttgctggtaataacgcttcagctctttctggttctgcatgtagccatcgccaatcatgctgatagcagaaacgcccatccccagcagatcggtatcgccctgggtcgtatagccctgaaaattacggtgcagcacgccttcgcgctgcgcgacggccagttcgtcatccggacgggcaaaatggtccatcccgataaactgataaccggcctgagtaagcgatacgatcgtctcctgcaaaatatccagtttctgctgcgcgctgggtaaatcggcatctttaattttacgctgggcggcaaaaagcgttggcagatgcgcatagttaaagacgctcaaacgatcggggttcagttccgtcacacgcttcagcgtgaaagcgaagctttccggcgtctgtttcggtagaccgtagatcaagtcgatattggtcgaggtaaagccgatatcgcgggcgtgattaagcaacgcaaagatgaattcttcatcctgctcgcggttaaccaggcgctgcacctctttattaaagtcctgcacgcccatactcaggcggttaaaaccttccgcacgtaaatgatcgagcacatccagctcaatttcacggggatcgacttcgatcgagatttccgcgtcggtattaaagtggaaattttcacgcaacagcgtcattaagcggctgatttgcgctttattcaggtaagtaggcgtaccgccgccccagtgaagctggctgacatgacggtctgcaaacagcggcgcgcgatggcgaatttcctgctcaagcgcgtcaagatactggtcagctttatgctgttggcgggtgacaatcttgttgcagccgcagaaataacacaacttgtgacaaaacgggatatgcacatacagcgagagcggacgttcaggataacgcgccacagcctgcaagaatgcggcgtcctcgaagtcttcagaaaactccagcgcggttgggtacgaggtatatcgtggcccggaatagttatatttctggatcagggccagatcccagtctatttgctgttcagacatgctcactccttccgatggcgtctctggcgggtacggcgtaccggcttcacgccatgacgggcggcaagccggctgcgcagccatttctgtcgccgcgacaatcgctgtagtttaacgaataaccacaccagataacatataaccggaagggttataagcaggacgggcaagcccacggtgtaaacccgttagttgccgcctcttagcaggcgcatcatatcttcctgcttctcgtcctcttcgtcgtcttcttcgtcgtcatcgtaagacagaccaagcttctgcatcagttcatcaatacgatccagtttggcatctacccaggcttgatcttccgcactcagggtttcgcccgcttccagacgttctaacagcgcatccaggcgctcatccgtttccagtaaatccaactccgcctgcggtgaaagcataggtttctcacttttcggtttatgctgttgggtcactttttcagtcacgcccaatggaacaggtgttttactgccaatacgtggatctttttgttgattctgattgccgccgcccgaagcggaattgccgcccgccgcgcgacttcccggcgcatggccgcgatgttttttcaggcgtttacggtcgcgcgcctcctggtttaactcttcacgcgttttacgacgctgtttgccaaaggctttactgcgcggtgcagaggttggttttttcatgatgtcagatctttaagccgttttattcagtatagaattgaggcggaatctagcagaaagcaagcaaagaaaaaaggcgacagagtaatctgccgccttttttcttgactcacgacccttaacgggttccaccatccctgttggctatcaacacgccctgtttttcccttagcctggaacattccatgttgtttccatttccttttactaacgtctccggacgtttgtcttcctgacaatcctgtgtcttcgcctcctggcgctcctgaccctcatcctgagtcgttgatcctgttagcgtcctcgctatgtgcattactttactcttttggggtaaactcacaagataccgacacggcaaatccctttttttcagacaattacctttctataaattcatgatttaactatattaactggcttttagcctgacaacaactctgtcatgtcgcataagtgcaatggacaatgtctcacaaagcgtatggcttttgcttacagcaccgacgcgccgaaaaatccgtcttttgctggcgttcaggtataatcgccacaatgctttgactgacggagacgaccgctttgactaacctgaattatcaacagacgcattttgtgatgagtgcgcctgatattcgccatttaccttccgattgcggaattgaagtggcttttgctggccgttccaatgcaggcaaatccagcgccctgaacacgttgaccaaccaaaaaagcctggcgcgcacctctaaaacgccgggccgtacccaattgattaacctgtttgaagtcgtagatggcaaacggttggtcgacctgccgggctatggctacgcggaagtcccggaagagatgaaacgcaagtggcaacgcgcgctgggggaatatctggagaaacgtcaaagcctacagggcttagtcgttttaatggatatccgccatccgttgaaagacctcgaccaacagatgatccagtgggctgtagagagcaatatccaggttctggttctgctgaccaaagcggacaaactggccagcggcgcgcgcaaggcgcagttgaatatggtacgtgaagccgtgctggcttttaatggcgatgtgcaggtagaagcgttttcctcgctgaaaaagcagggagtggataagttacgtcagaaactggatagctggtttagtgaactggcaccggtcgaagagattcaggacggggaataatcacccgctatgccggatggcgccgctgcgcgtcttatccggcctacggtgcgagcgaaacttttcttacgcccaataaaaaacgccccagtcataaactgactggggcggctaaaatattcagccaaatccgattacgtgaagtaaaaggtctgaaagatagaacatcttacctctgtaccctacgtgaataactttactcttttttgagcaacacagaaagaccttttcgtaatttttttttcattctttacatagggaattctaatacccatcacaaaacccccgtgcttatgttgcttaattacgaaaaaagcgcgttattccttaaatgcttagtgcgcttgatcccaattttctccgctaccgacttccaccagcaacggcacatcaatacgcgtgcagttttccatcaactgatggatacgttttgctaccgcatctaagtcgtctttatgcacctcgaacactaattcatcgtgtacctgcataatcatccgcacgcgtggctgctcggcctgtagccaggcatcgacggcaatcatggcgcgcttgatgatatcggcagccgttccttgcatgggagcattgatcgccgcgcgttccgcccccgcgcgccgcgccgcgttgctggatttaatatccggcaggtaaaggcggcgcccctccagagtttccacatagccttgttcttttgcctgagcgcgggtgcgctccatatattccagcacgccagggtagcgttcgaagtagagatccatatacttctgcgcctctttacgcggaatattaagctggcgagaaagaccgaaggcgctcatcccgtaaatcaggccaaagttaatggctttcgcacttcggcgctgttccccggtcacgctatccagcggcaagccaaagacttccgccgccgttgcgcggtgaatatctttcccttcggcgaacgccgtgagcagccctttatcacgggaaagatgcgccataatacgcagctcaatctgtgaatagtccgcagatacgatgagataatcctcaggcgcaataaatgcctgacgaatgcggcggccttcttcattgcgcaccggaatattttgcaggttcggatcggtggacgataaacgtcccgtcgccgttaccgcctgatgataggacgtatggacgcgcccggttttcgggttaatcatcagcggcagcttatcggtataggtggattttagcttcgccagaccacgatactccagaatcactttcggcagcggatagtccagcgccagctcttccagcacctcttccgacgttgacggcgcgccgccaggcgttttcttcaacggcttaataccctgcttttcaaacaggatggtctgcaactgcttcgtcgaggacaggttgaacgcctcgcccgcaatgtcatgcgctttcttttccagttccgccagacgtagcgtgatttcttccgaatgtttgtgcaggacggcaggatcgatttttacgccattgcgctcaacgcgtgacagtaccggcaccagcggcatttcgatgttttcgaaaacattcagcgggcctttgtgctgctggagctcaggccacattttgagatgcaactgtaacgtgacatccgcatcttctgccgcatagcgccccgcttcctccagtgcgatctggttaaaggtgagctggtttttacctttaccggcaatgtcttcaaaggtgatagttttgtgcttcagccaacgatcggacaagctgtccatatcatggcgtccggcgacgctgttcagaatgtaagactcaagcatggtatcgaaggcgataccgcgcagctcaataccgtaattttgcaagacgccgcgatcgtacttgaggttttgccccactttgcgcactttttcatcttccagcagaggcttcagcagttccagagcacgctggcgggagatttgatccggagcgtccagataatcatgcgcgacaggtacatacgcggcaacgccaggttcgatggcaaacgagaggcccaccaggttggcggcgatattatccaggctgtcggtctccgtgtcgaaagcaaaaactggcgcttttttcagcttttcaatccagctttccagcgtaacgtcatccagaatcgtgacataattttcataagagagcgccgctgccggttcgctgggcgattcatcaataacgaccgtttcctgcggtttggccgccggtttcgcgccctttgcctgtagccacttgcctgcctcgacgtccgccgtccagcgcttgaactcatattttttaaacaggcccagcagttcatccgcaatcggctgctgcacttcaagctgttcgcaggtcagctccagctcaacatccgttttaatggtggcgagcttataagacaggtacgctacgtctttattctgcgctaatttaccggccatcgttttggcgccgcggaaagtgagaccggcaattttttccggctcggcgtacagcgtatccaggccgcccaatccctgaagcaaggcttgcgccgtcttctcacccacgcctggtacgcccggaatattatccgaggagtcccccatcagcgccagaaagtcaataatcagctcagacggcacaccgtacttattaacgacttcatccgggccgaggatggtgttagtcatggtgttgatcagcgtaatattctgcgtcaccaactgtgccatatctttatcgccggtgctgattaataccggacgccccaccttctccgcttctcgcgccagtgtaccgataacgtcatccgcttctacgccagagaccgccagcagaggtaaccccatggctttaactatggcatgtaacggctctatttgcgcacgcagatcatccggcatcggaggacgatgcgatttgtagtgttcaaagagctcgtcacggaaggtttttcctttggcgtcaaacaccaccgcagcatgcgtcgactgatactgcatgatcaggctgcgcaacatgttgaggacaccatacattgcgcccgtaggttctcccgcgctgttggttaacggcggaaacgcatgataggcgcgatagagataggatgagccatctacgagaataagtgggttttctgggatctgaaccataatgtccgtgcctgtttaacagattatggttaaaggatgccacatacaggaggaaaacttgagtttttcgccgcatttgcggaaaagttttgtcgatcttcaggatcgctcgcaaaacaacctgtggataactttgtgtgtaaattcttaccattactttaaaatcagcgcgatagccttctcctcttaataattacccattattttcaatgagttgttaacatcacgattttctgattatctgattcatgccgttatcataatgtggatagttgttacgagtgtttctatttcactcagcgccatcattagcatcgttttctgatagaatcagcctcttgcgcccttttcgcacaccgtttatggctaacttttgaataatttattatgacgagaatactcgcggctatcacgctcccattgagtatcgtattaaccatcctggtcactattgtttgctcagtaccgatcatcgttgccggcatggtaaagctccttttgcctgttcccggtatctggcgcaaggtctccattttctgcaatttcatgatgtattgctggtgtgctggtcttgcagcgctgttacgccttaatccgcacttgcaatgggatgtagaagggttagaagggctgagcaagaaaaattggtatttactgatttgtaatcaccgcagctgggccgatatcgttgtgctttgcgttctgttccgcaagcatatcccaatgaataagtactttcttaaacagcaattggcctgggtgccgttcatcggcctggcgtgctgggcattagatatgccgtttatgaagcgctactctcgtagctatctgctccgccaccccgatcgacgtggcaaagatgttgaaacaactcgccgctcttgcgagaagtttcgtcggtatcccaccactatcgttaactttgttgaaggctcgcgatttacgcatgagaaacgtcagcaaacgcattcaccctatcaacatctgttgccaccaaaagcagccggtattgcaatggcgattaatgttttaggctcacagttcgataagctgcttaatattacgttgtgttacccaaacaacgatcgccaccccttctacgatatgctaagcggtaggctgacgcgtattgttgttcgggtgcaactggaacccataaatgaagaactgcacggcgattacgtgaacgacaaaacattcaaacgccgttttcaacgttggcttaatacgctgtgggataagaaagatatacagatagaagagattaaaacatcttataaaaacgccggtcagtgaccggcgttctttttattttttatcaaccaaatatttcacggtatcagcatactgctgaacaaaaacatccatgctgctggtatccatgccttgtgggttaatctggtatttgccattgacgaacatcgccggaacgccctgcagttgcaggtcagccgcggctttctcctgttgcgcaaccagtgatttcaccacgaagctgttccatgccgcatcgtaatcttcgccttttacgcccgcatcaacgaacactttacggatatccgcggcagattgtactgtctgggttttctgtacggcttcaaacagcgggaccgtgactttatcttctacccccaacgccatcgccaccgcccatgcctgggtgagctccttgcccaacggccccaggaactcaacgtggtacttggtcatcttggtgcctttcggcagctttttcttcacattgtcagacacatgaagcacttcttcaaactgataacaatgtgggcagtagaatgagaaaaactccagtacctggggttcgccagcgaccggtttatccagcgtgatatactgtttaccgtcgctgatctgtgctgccgaggcgctaaaaactaaaaccataccagccagcgccagccaaatctttttcatgatcaactctctccgattaatacattggcgttaattgtaaagggggttcgtgcaaaattttagtctgctcaataaaagtcgttgtctgtcgctgccagtaatcttcccctgttaaccagggaaagttttttggaaacgcaggatcgccccaacgacgaatcaaccaggcaagataataaactaaacgcatggcgcgtaaaggttcaatgagaccaatttcagccgtatcgaactcactaacttcttcataagcttcaataatggtttcaagctgcattcgctgttcggctttgttgccgttcagcagcatccataaatcctgtatcgccgggccgttacgggcatcatctaaatcgacaaacagcggtccatcacgccatagaatgttgccggcatgacaatcgccgtgcaatcgcagcgtggcgaaatcggtgcgccagcattcggtaaccgcagacagtagagtatcagtggctttcaggaaagccgctttttgcccggagggaatcagtgcggcatcttcgaatacctggcgaggttcaaaaagatactctgcaagcccaatgtcaggccggaaagtgaaaggacgttttcgccccgtctgatgcaatcggccaagataacgccctaccgcctccatctgatcgatattgtctgcttcaaactgacgaccgcctacgctggggaaaatggcataatgatagccctgatgcgctaacagcgtctggccattaaacgcgagcggagcagcaaccggaacctcatccttcaccagttcaagcgcgaattggtgttcttcccgaatttgatcaacagaccagcgttcaggacgataaaacttaacgacaaaacgtcgacggtcttcatcctgaaactgatagacgcggttttcataactgtttagtggagtcagcccggaatccaccctgatcccctgttcaaacagcgcatccatgatggtttccgggtgtagcgtctggaaagtaaaagcgttgtcgttcatcccatcatccggaaaatactacgaatgattcaggatatcatttcgtggcgatttcggtggtgccgcttacaaggttttactctttaataacgccgcgggcgcgtaaaagcgccgttttaaagtcctcttcatagtctttttgaatccctggaatggcggcgtctttggcggaatcgcgcattttcagatggtagatcaggatatcatcagttaaatcttccagtttgccgtcaaaacctgactctttcgccagtttctgcaaaaattgcgtcagattaagatcaggctctttctgccaggctggctggaggagttcaatgacttcattcaggcgtttacatttcatagctgtgctccttattcttgatacagacacggtagcagggtcaatcccacaataaaagaggcgatatcggtgaatctggatgaagtaataaccggcgtggtactggcaggcggtaaagcccggcggatgggaggtgcggataaaggtctgcttgaactggacgggaaaccgctctggcgacacgttgccgacgcgctcgcgccacaacttgctacggtcgtaattagtgctaatcgccatctggatatctaccaggccagcggcctgaaagtcattccggattcaatcgctgactttcccggtccgctggcgggtatgctttccgtttttcagcaggtagcaggcgactggtttctgttttgtccctgtgacaatccttgtatcccccacaacctggtcgatcgtttagcagcgcatcgtcatggcgcacccgtggtttgggttcatgatggagaacgcgatcatccaacgatcgcgttgattaatcgtgccgttgagccccagttgacagcttatttgcaagcaggcgagcggcgggtaatgatttttatgcgccaggtaggcggacacgccgttgatttcagcgattgtaaggaggcatttgtgaacgtcaacacgccggaggaactcgcgcaatggcaaaagagaccatgataccgctactcgccattgccgcatggagcggcacgggaaaaacaacactgctgaaaaaactgatcccagcactttgtgcgcacggtattcggccagggctgattaagcatacccatcatgatatggatgtcgataaaccgggtaaagatagctacgagctgcgtaaagccggggcggcacagacgctggttgccagtcagcagcgctgggcgttaatgacggaaacgccggggcaagaagagttggatctggcatggctggtgagccggatggatgcatcaaaactggatctggtgcttgttgaagggtttaaacacgaagcagttgcgaagatcttactttttcgtcagggatgtgggcacagcgaggaagaattaattcttgatgagcatgttattgcggttgccagtgatattccacttgccgtagcggtacccgttttggatcttaatgatgtatcgcagatttctgccttcattttgcggtggttagagaaagcacgttccttgtaggccggataaggcggagccgccatccggcggtgcaggttgcctgatggcgctgcgcttatcaggcctacatttttacagttaccacacatgcaaaaaagcccgtccgtcaggatgggcttcttcactaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccggttaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaatatctcaaacgtgactcgtaagtcagttttgagatactgatggcaacgcctttcacacattaccgcgcaagtggcgtcccctaggggattcgaacccctgttaccgccgtgaaagggcggtgtcctgggcctctagacgaaggggacgtatcagtctgcttcgcaagacgccttgctattcacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgcccccccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtgtattacgctttcccgcttcagagtcaagcgtttattttcgcttttctccgtgggattctggtctgaaccccgctgacccggcggcctgtgtgccgttgttccgtgtcagtggtggcgcattatagggagttatttctgcctgacaagaggaaatttaaaataattttctgagtgtctcttttttcatcaacagcgggcttaacgtgccataaaataagcaaattgccgttattgcaactgcaatcacacttccaggtggcatactaataaccaaacgaaagagaaaggaagaacattcatgcctttaagcgcacaacaattagccgcacagaaaaatctatcctatgttctggctgaaaagctggcgcagcggatattaaagggtgactacgcccccggtacgattcttcccggcgaaatagaactgggcgagcagtacggcgtaagtcgaacggcagttcgcgaagcggtgaaaacgttgacggctaaaggtatggtgctaccccgtccgcgcattggtacgcgggtgatgccgcagggaaactggaactttctggatcaagagctgctgacctggtggatgacggaagaaaattttcatcaggtggtagatcattttctggtgatgcgtattagcctggagccgcaagcttgcctgctggcggcgactcttggcacaccggagcagaaagcgcggcttaatgccttaatggaagagatggtcgcgctgaaaaagcattttaagcgtgaacgctggattgaagtggatatggcgtggcacgagcatatctacgaaatgagcgccaatccctttctaatctcttttgctacgctatttcattcggtttatcacacttactttacctcaatcacctataacgaggtggtaaagctggatttgcaccaggccattgttgatgccatcgctgatggcgacggcgaacgcgctttccaggcctgtcaggcgttgttaatagcgcccaatgagagaccagataattaacaggatattgaatgaccagcaaaaaagcgcgcagtatggctggcctgccgtggatcgcggcgatggccttctttatgcaggcgctagacgccaccattttgaataccgctttaccggctattgcgcatagtcttaactgttcaccactcgccatgcagtccgctattatcagttataccctgacagtagccatgttaattccggtaagcggctggctggctgaccgcttcggtacgcgtcgcgtctttatggttgccgtaagtctgtttacgttaggctcgctggcctgcgcgctctccagttcactatctgaattggttatttttcgcgtcgtacaaggcgtcggcggagcgatgatgatgccagtggcgcgactggcgttattgcgagcctatccgcgtagtgagctgctgcccgttcttaactttgtcactatgccggggctggtaggtccgattctggggccggtattaggcggcgtactggtgacctaggcaagctggcactggatcttcctgattaatattcccattggggttgcaggcattctgtatgcccgcaaatatatgcccaacttcaccacgccgcgtcgcaagtttgacatgaccggcttctttctttttgggttaagtctggttttattttccagcggaatggaactgtttggcgaaaagattgtggcgacatggatcgcatccgccattattttttgcagtatcgttctactattggcctatatccgccacgcccgccgtcatccgacaccgttaatatcactatcgctgtttaagacacgcacattttccgttggcattgccggcaacctcgccacgcgtctggggacaggctgcgtaccttttttgatgccgttaatgctacaggttggttttggctacccggctctgatcgccggctgcatgatggcgccgacggctttgggttctattatcgcgaaatcgaccgtaacgcaggttttacgacgtttgggatacaggaagacgctggtcggcattacggtatttatcggtctgatgattgcccagttttcgtttcaatctcccgctatgccgatctggatgctcgtactgccgctattcattcttggaatggcgatgtccactcaatttacggcaatgaatacgattactcttgcggatctgacggacgataacgccagcagcggcaacagcgttctggcagttacgcagcaattgtctatcagtttaggcgtggcgatcagcgcggcggtgttacgtatttatgaaggttttgcgggcaccagtaccgtggaacagttccactatacctttatcacgatgggggcgatcactatcgtgtccgcgctgatgtttatgctgctaagagccaaagacggcaacaatctgattaaagaacggcataaatctaaaccgacccacgcaccgtcaaaaccggagtaagctgaagtcgctgttgttgcaaggcgggctgcgccatccgatgaatcaacacatcaatagcaagctcgcccaattcatctttcggctgatggatagtcgtcagcggcggcgtcatatagcgcgctagctcaatatcatcatagccaatgactgccatatcttgcgggatacgaagccccgcctgatatagcgcctgataggcgccgacagccatcgcatcgtttccggtaaaaaccgcttgcggtcgctgttgatgggcgagtaacgcctgcatggcgtcaaagccgccgccaaattcaaaatcgccggtgatctcatagccttgcggaatagccagccctgcgcgtttcatcgccgcccgatacccttccagccgcaaacgcgcaggcgttttgtccagcgggccggtaatacaggctattcgggtaaatcctttatcgataaggtgttgggtcgcaagatcgccgcctaacaacgaattatcctgaatgagatcgctatcgccctcaccatcaaacggcgaccagtccatcatgacggtaggaatagacggataacgttccatgatttcacgagaaggctgatgcgtttcagtacacagcagcagtaaaccgtctacccgtttttgcatcagcgtctttaggttgcggttcatccgttgctcatcgccttcggtattacacagcaccagactataaccgcgctcaaaacagcttcgctcaacgccgcgcaccagttcggaataaaaagggttggtactggcggtaatcagcataccaatcgtgcgggtctggtttaacttgaggcttcgcgccagcgtggaaggcgcatagttaagtgatttaatcgccgcttcaactttttcagtaatcgtctcactcacaaagcgatctttgttaataacgtgagagaccgtcgatgtagagactcccgccaggcgggcaacatctttcatagtagccaagcgttacccctgctgatgtaaaaacgcttctatctcttcgcgccacggaacggaaggttgcgcgcctttacgcgttacggcaatcgcggcggcggcatgggcaaagcgaatcgcttccggcaacggcgtctcctccagtatcgcggtgataaaggcgccgttaaacgtatctccggcggcaatggtatcgacagcctcaacgctaaatccaggaacgcggcgaccctcgccgtttacgctggcccagacgccacggcttcctaaggtaattaatacggttcgaatgcctttatcatgtaaaacctgcgcagctttcgcgacatcgtcgtcatttttcacacgcacgcccgtcagcttttcagcttccgtttcatttggcgtgatgatgtccaccagcgccagcagttcatccggtaactcacgggcaggtgccgggttaagcgcaacagtagtatgatgttgatgggcgattttcgccgccgccagtacgctttccagcggcgattccagctgcatcagtaacgcatccgcctgcgcgatacgttcacgttgcgcatcaaccaacgccggcgataacgcggcattcgctccggcatgaataccgatgacgttctcgccttcgccattaacgaaaatcagcgctaccccggtagactcgcctttaatgacgctaactggcgcgatatcaatacgatcgctgactaattgtttacgaatactgtcgccaatatcgtcatcgcccgtgcaggcgataaacgcaatatttgccccgctacgtcccgcagcaaccgcctgattcgcgcctttcccgccaaacgcgacctgataatggctaccggttaccgtttcacccggggtagggaaggactcaagattaaggatatgatcggcattaatgctgccaaggacgatgagattacctgcggttttcatattcggggttccacgtcaaagtgcgccaccggttagggtggcgcgtgccctgcttttctttttttacgttcacctcagcggaggctcgcgtatttctgtcgccatcaggccatagttgacccgtgtcgtttattactgcttgatgaccagtttcaggtcaaccggatatttggcctgaactttttcgcctttcagcaccttatccgctacttcaacgcctttggcgccgatttgatccggtaactgagcgatagtcgctgccagtttgccatcttttacggccttttcgccatccggcgtaccgtcaaatccaaccaccatcacatctgctttaccggcagtttgcagcgcgcgcagtgcgcccagcgccatttcatcgttctgggcgaagacagcctgaacatccggatgcgcggtcagcaggttctgcatgacgttcagacctttagtacggtcgaaatcggcaggctggctggccaggacattaaatttgtgggcggctaccgcctgctggaaaccttcgccacgctcacgcgccgcagatgttccggcaatgccttgcagctcaatcactttggcgccttcgccagcttttttcgcgatatagtcgccagcgatcttaccgcccagcacgttatcagacgcgatatggctgacgacatcgcctttggttgcctggcggtcaagcgtgataaccggaatcttcgcctggttcgccatcttcaccgcgttacccaccgcatcggagtcagtcgggttgatcagcaaaattttggtcccgcgaacggttaaatcctgcacgttcgccagctctttggcagggttgttctgggagtccagcaccaccaggttataacccagtttatccgcctctttttgcgccccgtcttttaacgacacgaagaagggattattgagggtagagatcaccagcgcaatggtgtctttcgccattgcattcgcgctcacggtggcgctcagcgcaacagcagataccagggtagccagttttttcatgttcatatttcagatgtcctgtagtcgttgttactgctttttgttgtctaccagtaccgccagcaaaatcaccaccgctttgacgatcatctggtaataggaggaaacacctaacaaattcaaaccattattaaggaagccgagaatcaatgcgccgatcaatgtcccaacaatgcgccctttaccacctgcaaggctggtgccgcccagcaccacggcggcaatagcatccagctcatagccggtacccgccgtcggctgcgcggaagagaggcgcgccacttcaatgatgcccgccagcgatgctgtcaggccgcaaagtgaatagacgataattttcactttgctcacgctaatgccagacagacgcgtcgccgcttcgttaccgcccagcgcgtagatatagcgtcccagacgggtgtgatgcagcatataccaggcggcgataaagacgatagccatgatccagaccggcgtaggaacgcccagcggacgaccgataccgaaccagccaaacagatcggcgttatcggtaaagccggtgttgaccgggctaccgtcggtgtaaaccatcgtcacgccacgcagtagcagcatcatcaccagcgtagcgataaacgcctgtacgcggcccttcgcgacgataacgccagtgacggcgccaatcgcagcgcccagcgccagcgcggcggcaaccgcgaccagcgcattcacttcaacgccgacgattgaagcggcaaccgcaccggtgagtgccagcagggaaccgacggacagatcgatccccgatgtcagaatcaccaacgtcatccccaccgccataatggcgttgacggaggtctgttgaagaatattgaacagattattaacggtaaaaaagttggggctcaacgtcgaaacaatcgcgatcaacaccagcagggcaatgagcgacttctgctcaagaagccacgctttagtgaaataacggcgaccagaaacagcctgggttgtcatcttttttactcctgattcacgcgattaagcttgcccactgcggcagccattaacacttcctgggtggcctgctcgcgagtaaattcaccgctgagatgcccttcatgcatgacgatgatgcgatcgctcatgcctaatacttctggcatctcagatgagaccagaatgatgctcaggccgtcggccttaaactggttgataagctggtaaatctctttcttggcgccgacgtccacgccgcgggtcggctcgtcgagaatgagcactttcgggcgcgtcatcaacccgcgggcaatcgccactttttgctgattaccgccagaaagcaggcctatcgcctgttccattgacggcgtcttgacgttgaacagacggataaaatcccccaccgcctgctgctcatctttgtgtttcaggcttccgccagcgcgactgaaataatccagcgcagtcagcgacatattctctttaactgacatgccgagcaccagtccatcgcgcttacggtcttcagagatataaacgatgccattggccagcccgtcctgcggagaacgcgtcaccactttgtgtccctcgagcgtcacgtaaccgctggttcgcggcatcgcgccgtacaatactttcatcagctcagtgcgaccggtgcccatcaggccggagatgccaagaatctcgccttttcgcagcacaaaagagacatcgttcacgcccggtccgcacagattatcgaccttcaggcgaatctcacccggcgcgttatccagatgcgggtactgatcttccagcttacgtcccaccatcatttcgataagagaatcttcggtcaacgtggccacttcacgctcggcgataaattgcccatcgcggaagaccgtcacgtcatcgcaaatttcgaaaatctctttcatacggtgagagatatagacaatgccgcgcccctgcgattttaattcgcggataacgcggaacagagagtcggtttcagtgtcggtcagcgcatcggtcggttcatccataatgatgactttggattcgaagctcagcactttggcgatttccaccatttgctgatcgccgatagagagttcgcccaccagcttatcgctcttaaagcgcagattgagtttggctaagaggtggtcggcttcggcatacatctttttccagtcgattttaccaaagcgattcacaaactcacggcccaggaagatgttttccgcaatggtcaactgcggaatcaggttcagttcctgatgaataatgccgatcccggcttcctgagacgatttaggcccattaaaggtggtctctttacccagccataacaacgatcccgcatctcgcgtatagatgccggttaatactttcatcatggtggattttccggcgccgttttcccccaccagcgccataacgcggccaggataaacgtttaacgcggcgccggagagagccttcacgccggggaacgctttatcgatccctttgagttgcagtaatgcgtccatagcggcctcagaaagtgacgccagcgcaaataatgacgttcgcatacggggaacactccccgctgcgaatcactgcctgactgtctgcagtcaattttttgaattgttcgtgtgtcgtataactaatttttatggtgtttccctggtgttgctgcagttgctcaaggtgagtgagcaacgtttcgtggagctgcggattctgttgtttgatttccgttgcaagaatcgccgcctcaacctgcatttcccaggtcacgacatccaccacctgcataaaagaaggtacgccctgggttagtgccatatcgatacgcgcagtgctattcgggatgggtaaacccgcatcacagaccaccagagtatcagtatgccccagacgggaaatgaccgacgagatttcagagttgagtacggtgcctttcttcatttttctgctccactagcgaaacgtttcgctggccgcagtgtaaccctggatgtgttcataaaaccatcatgacgtaacagaattgtgatcgccgtcgaaacgtttcgctagcggaaatcaggtgaagataatcgcccaatggcgattatcttgtgggaatctacggattggccaggccgggtaagccaatgcggcccccggcatgttgatgagaggttaaatctcgacctgcgtacctaactcaatcacgcggttaggcgggatctcgaactgatccggcgcgcgcagggcgttgcgttgcaacaacaaatacagcttgccgcgcagacgcaaataccacgggcgtttgccgacaatcaacgactcgtgcgacataaagaacgacgtttccatcatccgacagctaaggccttccagaccgcagcggtggaacacctcttcaacgtttagcgtttcgcgccagccgtagctggccaccacgcgccagaatgtcggagacaactgctcaatctgcacccggcgaacgttatgcacataaggcgcatcttccgtacgcaacgtcagtaagattacgcgctcatgcaacactttgttgtgcttcaggttatgcaataaagcaaaagggatcacactgagcgcgcgcgacatgtatacggcagtacccggcacccgaaccggcggtgacttctccagtgaagcaatcatcgcttccagcgaattaccgtgttcatgcatacgacgcaacagacggaaacgctcgctcttccaggtggtcatgatcgtgaacatgatcagacccaggctcagcggcagccaaccgccggacaacaatttgtcgaggttagccgagaacagcgggatatccacgcacaggaatgcgatgaggatcagcgcgacaaaatatttgttccagtgccagttcttacgcgccacggtcgtagaaagaatagacgtcagcaccatcgtgccggtcacggcgatgccataggccgccgccaggttgctggagtgctcaaagctaacaataacaaccacgaccgcgaaataaagcagccagttaacgaaagggatgtagatctgaccggactccatctcggaggtatggataatgcgcattggcgacaaatagccaagacgcacggcctgacgcgtcagcgaaaagacgccggaaattaccgcctgggaggcgatcaccgtcgccagcgcggccagaatcagcagcggaattaacgcccagtccggcgccaacaggaagaaggggtttttaatcgcttccggatgctttagtagcaatgcaccctgaccaaagtagttcagtactaacgacggcaataccacggtaaaccacgccaggcgaatcgggaacttaccgaagtgtcccatatcggcgtacaacgcctctacgccggtaatcgacagcaccaccgcgcccaacgcaataaacgatacggttttatattcaaggaaaaaacgtaccgcccagacaggattcagcgcatgtaacacttcgggattggcgataatactgcgtaggccaagtaccgccaggattaaaaaccaggtcagcatgatcggcgcaaagagttttcctaccattcccgtaccgtgcttctgaatcataaacaacagagtcagcacaataatggagagcgggacaatccaggtatccagctgcggcgcgacaatctccaggccttcaatcgccgacatcaccgaaatcgccggcgtaatgaccacttcgccatagaaaaagctgccgcctatcagtcccatgataactaacatggatgtggtgcgcgccgaggtattacgcccggcaagcgacatcagcgtcaaaattccaccttcacccgcgttatcggcgcgcatcacgaaggtgagatatttgatggaaaccacaaagatgagtagccagaagatcagcgacagaaaaccaaacacggcatctcgttcaacgccaaaaccaaactgaccggacaaacattcacgaagcgtataaagcgggctggtaccaatatcaccgtagacaaccccaatagctgcgagggtaatcgcaggcaacgattgcttattatcagtgctcatagactcatctttcgtttatacacgtcacccttcacgctacctccttgtcgactgcattcgcttaccccagtcacacgtttaagtcagtgccaggggattcactcctttgccgccttgatgtagtttgaatgaatgagtgtatagatatgaaatgtgtgcttagtcccttggcccacaaaaaagcgcacagtatgcacgattaatcataaaatcgtacccctaaatgaagccagattaacctggctcaaagaaaaataaacagcgcgtcagaagattacagccccggtggtgaaacgtctatactcgcaattagcatgatccatttgtcgaaaggacgcctctttattatggctcacccacatttattagcggaaagaatttcccgtctgagcagcgcccttgagaaggggctgtatgaacgtagtcacgccatacgcctgtgcctactggcggcgttaagcggtgagagcgtctttttgttgggcccgcccggtatcgccaagagtctgattgcccgccgcctgaagtttgctttccagcgcgcccgcgcttttgaatatctgatgacacgcttttccacgccggaagaggtgtttggcccgctctctattcaggcgctgaaagatgaaggtcgctatgaacgcttaacgaccggctaccttcccgaagccgaaatcgtttttctggatgaaatctggaaagccgggcccgctatcctgaacacattgctgaccgccattaacgaacgccatttccgcaacggcgcgtttgaggaaaaaatcccgatgcggctactggtggcggcctctaacgaactgcccgaagcggacagcagcctggaagccttgtacgaccgaatgttgattcgcctgtggctggataaagttcaggataaagccaatttccgctccatgctggttagtcagcaggatgagagtgataacccggtccccgcctcgttacaggttagcgacgaagaatatcaacagtggcaaaaagatatcggcgcgatttcactgcctgatccggtctttgagctgatatttactctgcgccaacagctggataatttgccgaatgcgccttatgtctccgaccgtcgctggaagaaagccatccgcctgttacaggccagcgccttctttagcggacgcgacgcggttgcgccgattgaccttatcctgctaaaagattgcttgtggtatgacgcgcagagtctgaatctcatgcaacagcaactggaaatattgatgaccggacacgcctggcagcagcaggccatgctgactcgcctcggcggtatcgtccagcgccgcctccagttgcagcaacagcaaagcgataaaaccgccttcaccgtcattaaagaaggcggtatgttcagccgtcgcccgcattacactttaccgccggaagccagtgcgtcaacgttgacgttattgctacaaaaaccgctaaaactgcatgatatggaagtgatccatattacctttgaccgcagcgcgctggaactttggctgaccaaaggcggcgagatccgcggcaaactgaacgggatcggctttgcccaaacgctgaatatggaagtcgataacgctcaacatccggtggtgcgcgacatcagtctacaaggtacccgtctggcgttaccgggagcggctgaagacagtatgcctgcggagatcaaacagcagctggaaacgttagaaaacgactggcgccagcagcatacccgcttcagcgagcagcaacattgcctgtttattcacagcgactggttagggcgcattgaggccagcctgcaggatgtaggagaacagatccgccaggcgcaacaatgctgacgctggatacgctaaataccatgctggccgtcagcgaagagggaatggtcgaagagatgatcctcgcgctactggcttccccacagctggtcattttctttgaaaagtttccacgtttaaaaaacgccgtgaccgccgatctcccgcgctggcgggaagcgctacgcagccgtcttaaagacgcacgcgttccgccggaactcacggaagaggtcatgtgttatcagcaaagccaacttctctctaccccacagttcatcgtgcaactgccgcaaatactggcgttgcttcatcgcctgcattcaccgtatgccgcgcaggcgaagcagttgacggagagcaacagtacctttacccctgcgctacacacgctttttttgcaacgctggcggttaagtctggtcgtgcaggccaccacgttaaaccagcaactactggaagaagagcgcgagcagttgctgagtgacgtacaggaacggatgacgctgagcgggcaactggaaccgacgttggcggaaaatgataatgccgcaggccgcctgtgggatatgagcgcgggccagcttaaacgtggtgattatcaactgatcgtaaaatacggcgaatttctcgccgcccagccggagctaatgcaactggcggaacaactgggacgttcgcgggaagccaaatcggtaccgaaaaaagacgcgccgatggaaacctttcgtacactggtacgcgaacccgcaacggtgccggagcaggttgacggtattcagcaaggcgatgatattctgcgcctgttgccgccagagctggcgacgctcggcatcaccgagctggaatatgaattttaccgccggttagtggaaaaacagctcctcacctatcgcctgcatggcgaagcgtggcgtgagaaagtgaccgaacggccggtagtacaccaggatgtcgacgagcagccgcgcggaccgtttattgtctgcgtcgatacttcaggctcgatgggaggatttaacgagcagtgcgcaaaagcgttctgcctggcgttgatgcgcgttgcgctggcggataaccgccgctgctttattatgctgttttccactgacgttgtgcgttatgaactctccggcccggaaagtattgagcaggccatccgctttttaagtcaacgttttcgcggcggcacggatatcgccagctgttttcgcgccattattgaaagaatgcagggacgggaatggtttgatgccgatgcggtggtcatttcggattttatcgcccagcgcttgccggatgacgtggtgagcaaagtgggagagttgcagcgtcttcaccagcatcgattccatgcggtggcgatgtcggcgcacggcaaacccggcatcatgcgcattttcgatcatatctggcgctttgacaccgggatgcgaagccgcctgctgagacgctggcgacgctaacggcttataaaatagcaggaatgctttcgcgaacctgcgcgggccatacgccgcactgcacctgaccaatatgcggcaattgcagcagcaacatcgtcagacgcgactgcccaatcccgccgccgatggtctgcggcatttcgccgcgcagcagcgcctgatgtcactccagttgcaggcgatcttcatcaccggtcaacgccagctgacgcatcagcgtatcggcatctacgcggatacccatagaggaaagctcaaacgcatcttccagcaccgggttccacactaggatatcgccgttcagaccagcgtagcccagctcagatgcggagctccagtcatcataatccggcgcgcgtacatcatggcggcggccatcgctcagtttaccgccgatccccaccaggaaaacggcgccaagttctttggcgatcgcgcgttcgcgccctttcgcatccagatccgggaaacgcgccagcagttcctgactgtgaacaaaatggatctgatccggcaggaacggcgccagaccaaactgtttatgcacttccgcttccgtcgccttaatgcctgcccatatagcctctactgtgcttttcagggtggaaaattggcgctcgccatcgcccatgacacgctcccagtcccactgatccacatagaccgagtggagcggagagagtcggtcttcatcggggcgaagggctttcatgtgcgtgtacagcccttcgcccgcgctgaagtcatgttgccccagggtttgacgtttccacttcgccagtgaatgcaccacttcgaactgggcgtcaggcaacgctttcacttttacctgcaccgctttttcacagccggacaaattatcctgcgtaccatcccctacgcgactcaggatcggcgcctggacctcaatcagacccagacgctcctctagctggcgagagaaatgtgatttcacgaagctaatttgacgttgtttggcaatgtaagcggttttcatttttttactcctgcgtcctgttgcctatgattaagcaacaaaacgagagcactattcaataatcaacagataaaaagctaacttcgattttgattcgttaaaaataatggctaaaatagagataatcattaatctgcataagaaaaagcgatggaaaattatcagatcgacaatctggaccgcggcatacttgacgccttaatggaaaatgcccgcaccgcctacgccgaactggccaaacaatttggcgttagccctggaaccattcatgttcgcgtcgagaaaatgaagcaggccgggatcattacgggcgcacggattgacgtcagccctaaacaactgggctacgatgtaggctgctttattggcatcatcctcaaaagcgccaaagactatccctccgcactggcccggctggaaagcctggatgaggtgacggaagcgtattacaccaccggtcactacagcatctttataaaagtgatgtgcaaatcaattgacgcgcttcagcacgtacttatcaacaagatccaaacaattgatgaaattcagtccactgagacactgatcgtcttgcagaacccgatcatgcgcaccatcaagccatgatcggcttttttaatcccacatttttccacaggtagatcccagctcgttcacagagtacaatgcagcctctttacctgagcgagcgatcaatggcagacattactcttatcagcggcagcaccctgggcggcgccgaatacgtcgcggaacatctggcggaaaagctggaagctgccggtttttcaaccgaaacggtgcacggtccgttattagaggatctgtcaacttccgggatctggctgataatcagctcaacgcacggcgccggagacattccggacaacctgacccctttctatgaagaccttcagacgcagaaacccgatctttccgcggtacgtttcggcgcaattggcattggcagtcgagaatacgacacgttttgcggcgcgattgagaaaatagaagcggaactgaaaggcgctggcgcaaaacaggttggggaaacactgaagatcaacatccttgaacatgagattccggaagatccagcggagatttggctcggatcctggattaatttactcaaataagtgtaaagatcgtgcgatctattgtggataaatatggtgaaaagcttggatcaaccggtagttatccaaagaataacctttgttcactttttgagttgtgtataagtacccgttttgatcccagcttatacgggccacgatcaccgatcattcacagctagtgatcctttccaacgcattgatctttattacaggatccgggttatccacagcctggtgcgatcctaataagagatcacaatagaacagatctctaaataaaaagatcttctttttaatagcccggatcccggggctttctccatcggctaaagttgagtagaatccaccgcccgggcttcaatccattttcacaccgcgttatgcgaggcaattaccatgttttatcaggatccttttgacgtcattattattggcgggggtcatgcaggcactgaggccgcgatggccgcagcgcgtatgggtcaacagactctgcttttgacacacaatattgacacgttggggcagatgagctgcaacccgacgatcggcggtattggcaagggacatctggtaaaagaggtggatgcgctcggcggtctgatggcgaaagcgatcgatcaggcaggtattcagtttaagatactaaacgccagcaaaggtccggccgttcgcgctacccgagctcaggcggatcgagtcttatatcgccaggcggtacgtatcgcgctggagaatcagccgaatctgatgatcttccagcaagcggttgaagatctgattgtcgaaaacgatcgcgttgtcggcgccgtgacccaaatggggctcaaattccgcgcgaaagcggtggtgctgaccgtcgggactttcctggacggcaaaattcatattggtctggataactacagcggcggtcgtgctggcgatccgccatccatcccgctgtctcgccgtctgcgtgagcttccgctacgcgtcagccgcctgaaaaccggcacaccgccgcgtattgatgcgcgtactatcgatttcagcgtgttggctcaacagcatggcgataacccgatgccggttttctcgtttatggggaatgcttttcagcatccgcaacaggtgccgtgttacatcacgcataccaatgagaaaacccatgacgtgattcgtaataacctcgatcgtagcccaatgtacgctggcgtgatcgaagggatcggcccacgctactgtccttcgatcgaagacaaggtgatgcgttttgccgatcgtaaccagcatcagatcttccttgagccggaaggactgacctctaacgagatttaccctaacggtatctccaccagcctgccgtttgacgtgcagatgcagattgtccgttccatgcagggcatggagaacgcgaagatcgttcgccctggttacgcgattgagtatgatttcttcgacccgcgagatctgaaaccgactctggaaagtaaatttattcacggcctgttctttgctggtcaaatcaacggtactaccggctatgaagaggctgcggcgcagggcttgctcgctggtctgaatgccgcgcgtctttccgccgacaaagagggctgggcgcctgcgcgttctcaggcttatctcggcgtgctggtggacgatctctgtacgctgggcaccaaagagccgtatcgcatgtttacctcccgcgccgaatatcgcctgatgctgcgtgaggacaacgccgatctgcgtctgaccgaaatgggccgcgagctgggtctggtggatgatgaacgctgggcgcgcttcaacgagaagctggaaaatatcgaacgcgaacgtcagcggctgaaatcgacatgggtaacgccgtctgcggaatccgctgatgaagtgaatgcgcatttgaccacgccactctcccgtgaggccagcggcgaagatctgttgcgtcgtccggaaatgacatatgcgcagctcacttcgcttgccgcattcgcgcctgcgcttgaagatgagcaagccgctgaacaggtggaaatccaggtcaaatacgaaggctatatcgctcgccagcaggatgagattgaaaaacaactacgtaacgagaatacgttgctgcctgccacgctggattatcgtcaggtttccggtctgtcgaacgaagttatcgccaagctgaacgatcataaaccggcgtctatcggccaggcatcgcgtatctccggcgttacgccagcggcaatctccattctgctggtatggctgaaaaaacaaggtatgctgcgtcgtagcgcttgataacactaatttggcgggggcgcttcgcttgcccgccctacaaatttgtaggcccgataagcgaaagcgcatcgggcatttgattattaacaggtaatgaccgtgctcaacaaactctctcgtctgctggctgatgccggtatttctcttaccgatcaccagaaaacgctgctggtcgcctacgttgatatgctgcacaaatggaacaaagcatacaacctgacgtcagtgcgggatcccaacgaaatgttggtacgccatattctcgacagcatagtcgttgcgccgtatctgcagggacagcgttttatcgatgtaggaacaggaccggggctgccgggcatcccgctggctattgttctccctgacgcgcatttcaccttactcgacagcctgggcaagcgggtacgttttctgcgtcaggtccagcacgaactgaaactggaaaacatcacgccggttcaaagccgcgttgaagcctatccctccgaaccgccgtttgatggcgttatcagccgcgctttcgcatcgttgaatgatatggtgagctggtgtcaccatctgccgggagagaaaggacgtttttatgccttaaaagggcaattgccaggggatgaaattgcctcactacctgacaattttagcgtcgaatctgttgaaaaattacgcgttccgcaactggaaggcgagcggcatctggtgattattaagtcaaacaaagtttaatttttatcaaaaaaaatagaaaaaacgacgcggcttgtgttaaaaatcgacaggtataacgcatttcagagttgttacatttaactctggatttacggtttcgtttcaacatgacaacgtcgcttcttttgttaaaacagagagtaatcaactttgtaaatatcagtctgctaaaaatcgaatcgaaaaatcacttttgcttgttaaatttttattataaatgtcaatggggcgtttttaaggtgtaagctggtatttttaaaacagtacctggttttacgcttaaatatcaaaaagatgaaaaggcatgaattgacacgtaaatgaattgcgtaagcatgaatatgtttaatgtgtgatctggtgcacgctttatcgccagtgttttcgcgctatttgcagttttgtacgatcgttcacactttagctaaaagttaaaaatgcgggccagagaaaaatatttaaacatttattcaccttttggctacttattgtttgaaatcacgggggcgcaccgtataatttgaccgctttttgatgcttgactctaagtcttaaagaacgttttatacgacacgcggcatacctcgaagtgagcaggagtaaaaacgtgatgcctgtgtcgctcgtgagtcgaaacgttgctcgtaagcttctgttcattcagtttctggcggtaatagcaagtggattgctgttttgcctcaaagaccccttctggggcatctccgcagtatgtgggggattggcagtggcactgcctaatatgttgtttatgatatttgcctggcgtcaccaggcgcatacacctgctaagggccgcgtgtcctggactttcgccttcggtgaagccttcaaggtgttagcgatgctggttttactggtggtggcgttggcggttttaaaggcggtgtttttgccgctgatcgttacgtgggttttggtgctggtggttcagatactggcgccggctgtaattaacaacaaagggtaaaaggcatcatggcttcagaaaatatgacgccgcaggaatacataggacaccatctgaataaccttcagctggacctgcgtactttctcgctggtggatccgcagaaccccccagccaccttctggacgctcaatattgactccatgttcttctcggtggtgctgggtctgttgtttctggtgatgttccgtagcgttgctaaaaaagcgaccagcggcgtgccaggcaagtttcagaccgcgattgagctgatagtcggctttgtgcatggcagcgtcaaagacatgtaccatggcaaaagcaagctgattgcgccgctggccctgacgattttcgtctgggtattccttatgaacctgatggacttactgcctatcgacctgctgccgtatatcgctgagcattggctgggtctgccggcaacgcgcgtggtgccgtctgctgacgtcaacatcaccctgtcgatggcgttgggcgtattcatccttattctgttctacagcatcaaaatgaaaggcatcggcggcttcgcaaaagagttgacgctgcagccgttcaatcactgggcgttcattcctgtcaacttaatccttgaaggggtaagtctgctgtccaaaccggtttctctcggtctgcgactgttcggcaacatgtatgccggtgagctgattttcattctgattgctggtctgttgccgtggtggtcacagtggattctgaatgtgccgtgggccattttccacatcctgattattacgctgcaagccttcattttcatggttctgacgattgtctatctgtcgatggcgtccgaagagcattaatttaccaacactactacgttttaactgaaacaaactggagactgtcatggaaaacctgaatatggatctgctgtacatggctgccgctgtgatgatgggtctggcggcaatcggtgctgcgatcggtatcggcatcctcgggggtaaattcctggaaggcgcggcgcgtcaacctgatctgattcctctgctgcgtactcagttctttatcgttatgggtctggtggatgctatcccgatgatcgctgtaggtctgggtctgtacgtgatgttcgctgtcgcgtagtaagcgttgcttgaattaagagcaatatcagaaggttaactagatagaggcattgtgctgtgaatcttaacgcaacaatcctcggccaggccatcgcgtttattctctttgtctggttttgcatgaagtacgtatggccgccgttaatggcagccatcgagaaacgtcagaaagaaattgctgacggtctcgcttctgctgaacgagcacataaggatcttgaccttgcaaaggccagcgcgaccgaccagctgaaaaaagcgaaagcggaagctcaggtaatcatcgagcaggcaaacaaacgccgcgctcagatcctggacgaagccaaaactgaagcagagcaggaacgtactaaaatcgtggtgcaggcgcaggcggaaattgaagccgagcgtaaacgtgcccgtgaagagctgcgtaagcaagttgctatcctggctgttgctggcgccgagaagatcatcgaacgttccgtggatgaagctgctaacagcgacatcgtggataaacttgtcgctgaactgtaaggagggaggggctgatgtctgaatttgttacggtagctcgcccctacgccaaagcagcttttgactttgccgttgaacaccaaagtgtagagcgctggcaggatatgctggcgtttgccgccgaggtaaccaagaacgaacaaatggcagagcttctctctggcgcgctggcgccggaaacgctcgctgagtcgtttatcgcagtctgcggtgagcagttagacgaaaacggtcagaacctgattcgggtgatggctgaaaataatcgtctgaacgcgctcccggatgttctggagcagtttattcatctgcgtgccgccagtgaagctacctccgaggtagaagttacgtcggcaaccgcattgagtgaagagcagctttcgaaaatcagcgccgcgatggaaaaacgtctgtcacgcaaagtgaagctgaattgcaaaatcgataagtctgtaatggcaggcgttatcatccgggcgggtgatatggtcattgatggcagcgtacgcggtcgtcttgagcgccttgcagacgtcttgcagtcttaaggggactggagcatgcaactgaattccaccgaaatcagcgaactgatcaagcagcgcattgctcagttcaatgtggtgagcgaagctcacaacgaaggtactattgtttctgttagtgacggtgttatccgcattcacggcttggccgattgtatgcagggtgaaatgatctccctgccgggtaaccgttacgctatcgcactgaacctggagcgcgactccgtgggtgcggtagtcatgggtccatacgctgaccttgccgaaggcatgaaggttaaatgtacgggtcgtatcctggaagttccggttggccgcggtctgctgggacgtgtggtaaacaccctgggtgcgccaatcgacggtaaaggtccggttgataatgacggcttctctgccgttgaagcgattgcgccgggcgttatcgatcgtcagtctgtcgatcagccggtgcagaccggctataaagccgttgactccatgatcccaatcggtcgtggtcagcgtgaactgatcatcggtgaccgtcagaccggtaaaaccgcgctggctatcgacgccatcatcaaccagcgcgactccggcatcaaatgtatctatgtcgctatcggccagaaagcgtccaccatctctaacgtggtgcgtaaactggaagagcacggcgcgctggctaacaccattgttgtggtggcgaccgcgtccgaatccgctgcgctgcaatatttggcgccgtatgccggttgcgcaatgggcgaatacttccgtgaccgcggtgaagatgcgctgatcatttacgatgacctgtctaaacaggctgttgcttaccgtcagatctccctgctgctccgtcgtccgccaggacgtgaagcattcccgggcgacgtattctacctccactctcgtctgctggagcgtgctgcgcgtgttaacgccgactacgtcgaagccttcactaaaggtgaagtgaaagggaaaaccggttcactgactgcgctgccgattatcgaaacgcaggcaggtgacgtttccgcgttcgttccgaccaacgtaatttccattaccgatggtcagatcttcctggaatctaacctgtttaacgccggtattcgtcctgcggttaacccgggtatctcggtatcccgtgtaggtggcgcagcccagaccaagatcatgaaaaaactgtccggaggtattcgtaccgcgctggcgcagtatcgtgaactggcggcgttctctcagtttgcatccgaccttgacgatgccacccgtaaacagcttgaccacggtcagaaagtgaccgaactgctgaaacagaaacagtatgcgccgatgtccgtcgcgcagcagtctctggttctgttcgcagcagaacgtggttatctggcggatgtcgaactggcgaaaatcggtagcttcgaagccgcactgctggcttacgtcgaccgtgatcacgctccgctgatgcaagagatcaaccagtccggtggctataacgacgaaatcgaaggcaagctgaaaggcatcctcgattccttcaaagcaacccagtcctggtaacgtctggcggcttgccttagggcaggccgtaaggcattgaggagaagctcatggccggcgcaaaagagatacgtagtaagatcgcaagcgtccagaacacgcaaaagatcactaaagcgatggagatggtcgccgcttccaaaatgcgtaaatcgcaggatcgcatggcggccagccgtccttatgcagagaccatgcgcaaagtgattggtcaccttgcgaacggtaatctggaatataagcacccctacctggaagagcgcgacgttaaacgcgtgggctacctggtagtgtcgaccgactgtggtttgtgcggtggcttgaacattaacctgttcaaaaagctgctggcggatatgaaggcatggtccgataaaggcgttcagtgcgaactcgcaatgatcggctctaagggcgtgtcattctttaattccgtaggcggcaacgttgtcgctcaggtgacaggtatgggggataacccttctctgtccgaactgatcggtccggttaaagtgatgttgcaggcctacgacgaaggccgtctggacaagctttacattgtcagcaacaaatttattaacaccatgtctcaggtgccgacgatcactcaactgctgccgctgccggcgtcagaagatgatgatctgaagcgtacagcctgggattacctgtatgaaccagacccgaaagcgctgctggatactctcctgcgtcgttatgtggagtctcaggtttatcagggcgtggtagaaaacctggccagcgagcaggccgcacgaatggtggcgatgaaagccgcaaccgataatggcggcagcctgattaaagagctgcagttagtatacaacaaagctcgtcaggccagcattactcaggaactcaccgagatcgtctcgggggccgccgcggtttaaccaggttatttcgtagaggatttaagatggctactggaaagattgtccaggtaatcggcgccgtggtagacgtcgagttccctcaggatgccgtaccacgcgtgtacgatgcccttgaggtgcagaatggtaatgagaagctggtgctggaagttcagcagcagcttggcggcggtatcgtgcgtaccatcgcgatggggtcttctgacggtctgcgtcgcggtctggatgtaaaagatctcgaacacccgatcgaagtcccggtaggtaaagctacgctgggtcgtatcatgaacgtcctgggcgaaccggtcgacatgaaaggcgagatcggcgaagaagagcgttgggcgattcaccgcgcagcgccttcctacgaagagttatcaaactctcaggaactgctggaaaccggtatcaaagttatcgacctgatgtgtccgttcgcgaagggcggtaaagtcggtctgttcggtggtgcgggtgtaggtaaaaccgtaaacatgatggagcttatccgtaacatcgcgatcgagcactccggttactctgtgtttgcgggcgtaggtgaacgtactcgtgagggtaacgacttctaccatgaaatgaccgactccaacgttatcgataaagtatccctggtgtatggccagatgaacgagccgccgggaaaccgtctgcgcgttgcactgaccggcctgaccatggcggagaaattccgtgacgaaggtcgtgacgtactgctgttcgtcgataacatctatcgttacaccctggccggtacggaagtatccgcactgctgggtcgtatgccttccgcggtaggttaccagccgactctggcggaagagatgggcgttctgcaggaacgtatcacctccaccaagaccggttctatcacctccgtacaggcggtatacgtacctgcggatgacttaactgacccgtctccagccaccacctttgcgcacttagatgcaactgtggtactgagccgtcagatcgcatccctgggtatctacccggccgttgacccgctggattccaccagccgtcagctggatccgctggttgttggtcaggaacactacgacaccgcgcgtggcgttcagtccatcctgcagcgttatcaggaactgaaagacatcatcgccatcctcggtatggatgaactgtctgaagaagataaactggtggtagctcgcgcgcgtaagatccagcgcttcctgtcccagccgttcttcgtggcggaagtatttaccggttctccgggcaaatacgtctccctgaaagacaccatccgtggctttaaaggcatcatggaaggcgaatacgatcacctgccggagcaggcgttctacatggtcggttccatcgacgaagccgtggaaaaagccaaaaaactttaacgccttaatcggagggtgatatggcaatgacttaccacctggatgtcgtcagcgcggagcaacaaatgttctccggtctggtcgagaaaatccaggttacgggtagcgaaggtgaactggggatctacccggggcacgcgccgctgctcaccgccattaagcctggtatgattcgcatcgttaagcagcacggtcacgaagagtttatctatctgtccggcggcattctggaagtgcagcctggcagtgtgaccgttctggcggataccgcgattcgcggtcaggatctcgacgaagcgcgagccctggaagcgaagcgtaaagccgaagagcacattaagagctcgcacggtgacgtggattacgctcaggcgtctgcggaactggccaaagcgatcgctaaactgcgcgttatcgagttgaccaaaaaagcgatgtaacaccggcttgaaagcataaaaccagtctgattgcggactggttttttttatcctctcaatttttattcgataaactagcaacgacaaaaacaagcggctgaaggcgatgcgttttcagcgacagcgctgttttcattaaatccttctttctgtcattggcatctgcacattgtgcgaagaaggaaggaatggatgcgtttttattgcataaaatgagggattattactatgtcatttcagccatcctttgcggggccacaacccgactcaaggattgatcgtactacctttattcgtcgcgcttatcttcatctcgccgtcgccatcgtcggttttatcgtgttgagcgcggcgtggagttttatagggggcggggagtatgcgcttgatgtgctgctggctggtggaagatatagctggttggttgttctcggcgcttttatgctggtgggaatgctggcgacccgtctggcggataatgcggggactaatcaaacgcaacttatcgggctggggatttatgtgttggcagaatccctgatttttgcccccctgttaacggtggcggcgtatattaacccgtcgagcattggcgcggcggcaataacgcccctgttgctggttggcggtctgacgtttaccgcgttttccataaaaaaagacttttcttttctgcgctcgtttctgactatggctggattcattgcttttggcgcgattattgccagcgtcatctgcggcttttcgctgggcgtctggttttctgcgctaatggtactgctgtgcgccgggtttatactttacgacacttctaacattattcaccattaccctaccgatcgccctgctggcgcggcattacatctgtttgcttctatcgcgaccatgttctggtatattttgcggatttttatgtcgcgtaattaagtaaaaaatacgcgcaacggaaaaccagcggcctctgtcgctggtttttgcttttctgactcccctgcgctttatttcgttatcttctttatttatggagtaaaaaaacagcaaaaacatcggactacgttgccaatacgcgggtgtttttacttttcaggagacaagaggcgcggtaatgaacgaaaatgattcattagcaggcggggattttatcccggtgagcgttttatccttcttccattttacgatgaaaaaaatgtagtattttcaacgtgaaacagtataaattcgttctcaaattacagtcaggacgcgtatgttaaatagtgctatgagcgtagtgatccttgccgcaggtaaaggcacgcgcatgtattccgatattcctaaagtgctgcacacgctggcgggtaaacccatggtgcagcatgtcattgatgcagctactaaattaggggccgcacaggttcatctggtctatggccacggtggcgagttgttaaaacagaccctgaaagatgacaagctgaactgggtgcttcaggcggaacagttgggaacaggtcacgcaatgcagcaggccgcgcccttttttagcgacgatgaagatattttaatgctttacggcgacgtgccgctgatttcggttgaaaccttacagcgcctgcgcgatgccaaaccgcagggtggtattgggttattaaccgtgaagctggacgatccgagcggctatggccgtattacgcgtgaaaacggtaaagtgaccggcatcgttgaacataaagacgccactgatgaacagcgtcagatccaggaaattaacactggtattctgatcgccaacggcgcggacctgaaacgctggttgtctaagctgactaacaataatgcgcagggtgaatattacatcacagatatcatcgcgctggcttatcaggaaggacgggaaatcgccgcggtgcatccggctcgcatcagcgaaacggacggcgtgaataaccgtctacagctttctcgtctggagcgtatttaccaggccgaacaggcggagaaactgctgttatccggcgttatgttgcgcgatccggcacgttttgatctccgcggcaccctttattgtggaatggatgtcgaaattgacgctaacgttatcatcgaaggttatgtaacgctcggtcaccgcgtgaagatcggcgcgggctgcattattaaaaacagcgttattggcgatgactgcgaaattagcccatacagcgtggtggaagatgcgcatctggaagcggcctgcaccatcggcccgtttgctcgcctgcgtcccggcgctgagctgttagcgggcgctcacgtcggcaattttgttgaaatgaaaaaagcgcgtctgggtaaaggttctaaagccggccatctgacctacctgggcgatgcggaaattggcgacaacgtgaatattggcgcggggaccatcacctgtaactatgatggcgcgaacaaattcaaaacggttattggcgacgatgtgtttgtcggctccgatacccaactggtggcgccggttactgttggtaaaggggccaccatcgccgcagggactaccgtcacccgtaatgtagccgacaatgaactggtattaagccgcgtgccgcaggtgcataagcaaggctggcagcgtccggtgaagaaaaagtgattttgtaggccggataagcgtcagcgccatccggcagaccggagatgagaggataaaataatcctccgctccatgagcagtacttataaaaataaccccactctctacaaggctcggggcgcccgcaacgacgggcatacaggtcagcgacaacgcatggcgtaatgccataatcaggaaataaaactatgtgtggaattgttggcgctatcgcgcagcgtgatgtagctgaaatccttctcgaaggtttacgtcgtctggaataccgtggttacgactctgccggtctggccgtggtggatgcagaaggtcatatgacccgcctgcgtcgcctcggtaaagtccagatgctggctcaggcagcggaagaacacccgctgcatggcggcaccggtattgctcacactcgctgggcgacgcacggtgaaccttcagaagctaacgcgcatccgcatgtttctgaacacattgtggtggtgcataacggcatcatcgaaaaccatgaaccgctgcgtgaagcgttaaaagcgcgtggctataccttcgtttctgaaaccgacaccgaagtgattgcacacctggtaaactgggaactgaaacaaggtggtactctgcgagacgcgattttgcgtgcgatcccgcaactgcgtggcgcatatggcacggtgatcatggatacccgccatccggatacgctgctggctgcccgttcaggtagcccgctggtgattggcctgggtatgggcgaaaactttatcgcttctgaccagctggcgctgttgccagtgactcgtcgctttatcttccttgaagagggcgatatcgctgaaatcactcgccgttcggtaaatatcttcgataacaccggcgcggaagtaaaacgtcaggatatcgaatccaatctgcaatatgacgcgggcgataaaggtatttaccgccactacatgcagaaagagatctacgaacagccgaacgcgatcaaaaacacccttaccgggcgcatcagccacggtcaggtggatttaagcgagctgggaccgaacgccgatgatctgttgtcgaaggttgagcatattcagatcctcgcctgcggtacgtcttacaactccggtatggtttcccgttactggtttgaatcgctggcaggtattccgtgcgacgttgaaatcgcctctgaattccgctatcgcaaatctgccgtgcgccgtaacagcctgatgatcacgctctcccagtctggcgaaacggcagataccctggctggcctgcgtctgtcgaaagagctgggatatttgggctctctggccatttgtaacgtgtcgggctcttcgctggtgcgtgaatccgatctggcgctgatgaccaacgcgggtacggaaattggcgtagcatctaccaaagccttcaccacccagttaaccgtgctgttgatgctggtggcgaaactgtctcgcctgaaaggtctggatgcgtccattgagcatgatatcgtgcatggcctacaggcgctgccgagccgtattgagcagatgctgtcgcaggacaaacgcatcgagctgcttgcagaagatttctctgacaagcatcacgcgttattcctcggtcgtggcgatcaatatccgattgcgctcgaaggcgcgctgaagctgaaagagatctcttacattcacgcggaagcctatgctgcaggcgagctgaaacacgggccgttggcgctgattgacgccgatatgccggtgattgtggtggcgccgaacaacgaactgctggagaaactgaaatccaacatcgaagaagttcgcgcgcgtggcggtcagttgtacgtcttctccgatcaggatgcgggttttgtgagcagcgacaacatgcacatcattgagatgccgcatgtggaagaggtcattgcgcctatcttctacaccgttccgctgcaactgctggcgtatcacgtggcgctgattaaaggcaccgacgttgaccagccgcgtaacttggcgaaatcggtgacggtagagtaagtcaaatgttgtaccaaaaaaaaggctgtcgatagacggcctttttttatgagttttttgaacaaaaataaaaaatatttacgggagatgagaataacggaatagtggttgataaataaacaattgtttgattgttaaactaaaaaataaattttttcctaaaaatatgtacgttaaatgtctctgactttagtgtttgtatataattatttatattctttggtttagtaaaaataaaattttaaaaagataatattgcctgttatttcactcaaacaattccattgtgtaaatttgactgcttgatatttattttctcgggagtagtattcgcttccgttgtagacacattgtgttttatttatttttaaatgaaacatcgggatatataatatatcaatagagttataatgaaactgaatttaattgccagcgctctggttctgtcttctactatgctggtaggtaatgcaatggcatctgatggcaccgttcacttccttggtgaagtggttgacagcacctgccaggttacgccacaaaccgctgatcaaaacgttaatttaggcaaagttaacaaaacggcatttgctggcgtgggaagtaccgctgcgcctaccgagttccatatcgacctgaccgggtgcccggctacgtatactaaggctgccgttcgttttgatggtaccgaagcttccaacagcgatggcgacctggctatcggcaaccctgctaatggcgatgccccgggtgattacaccggtgacggcgctgccattacagcatctggcgtagcgatccgtatttacaaccgcgcggataactcacaagttaaactgtacaacgattctgcgtatagcacgattgataccacagcgggtacggcttctatggagtttatcgcgcgttatatcgccactgacgcaaccgtcactgcgggtactgctaacgcagattctcagttcactgtcgaataccaaaaataagattcgctcttcttaaacgtcttttattaatttattgacgcctgccattgtgaacaactgtagttgtataaatgcccggcgtcttttttatccagggatgagtttgtctatgtttgctcgtggaataaaaatagttattctggcactcctgtgccttaatcttccctctgcttttgcaggtattgtggtcggtggaactcgcgtcatttttcatggcaacgatcctgactctactatttctatttacaataaagaagttgatttgccttatctaatacaagtatgggttgatcctttcagtaaggatgataagagcaaaccaccttttaccgtcattccgcctgtttctcgtcttgagccgagtcaggaaaaagtgctgcgcattattaaaacagcgggtgagttgccaaaggatcgcgaatctgttttttggtttaatgtgaaaaacattccgccatccagtaaaaataaagatagcagtacgcttgagatcgcaattaaaacgcgtatcaagttattctggcgcccggcctctattacgcttatcccggaaaaggcggtagctaaagtcaaatggtatcgacagggaagtaaactggttgtagaaaataatagtcctattcatatgaatatcatggatgtctctgtagacggtaaagatgttccattgaatatgataaagccttttgaaaaattaacgttggatttacctactggtgttacggggcacgctttagcctggcgttttattaatgattacggcgcgattagtagccctgttaagcaagcgctttagttttgcgataaggatatcttgatgattcaccctcgtctttgcctcgtcttgatttcaggtgcttatctgagtatcgttttcccgacaatggctagggaaacgctatttaaccctggtttgctggaaattgatcaccccgtggacgtggatattcatcagtttaaccgttccaacgcgttgccgccgggcgattataaggtcgatatcgtcattaacgggaaactgtttgaacgacgggatgtgacctttgtgcaggatcaaccggatgccgaactgcatccctgctttgtcgcggttaaggatgtattgtcgtcgtatggtgttaaggtagacgcggtgaaaggcttgcaggatgtcgataatacagcctgcgtgaatcccgttccgttaattgatggcaccacctggttattagatgcgaataagctggcgttaaatatatctgttccacagatctatctgaacacggcggcctatgactatatcagcccgtcacgctgggatgagggcatcaatgcgatgatggtcaattaagatttttccggatcgcacacggtaaagtctaattacgacaatgggaacgatgactcttattatctgaacctgcgtaacgggattaacctgggagcatggcggttgcgtaactacagtacgctgagcgccaccggcagcgacacggaatatcactccatcagtagctatgtccagcgcgatatcgccgcgctgcgcagccagattatggtcggcgacacctggacggcgagttatgtctttgatagcgcccagatccgcggggtcagactctataccgacgatgacatgctaccgtcgagccagaacgggtttgcgccagtggttcgcggggtggcgaaaagtaacgccaccgtcatcatccggcagaatagatatgtcatttatcagtcagccgtgccgcagggcgctttcgagatcaccgacctgaacaccaccagcggcggcggcgatcttgatgtcaccataaaagaagaagacggcagcgagcagcactttacccagccgtacgcgtcgctggcgatactgaagcgtgaaggccagaccgattttgatattagcgtcggtgaaatgcgcgatgaaagcggatttacccctaacgtcgttcaggcgcaggtgttgcatggcctgccatggggattaacgctctatggcggcacgcaggttgcggaagattatgcttccgccgcgcttggtatgggtaaagatatggggtcgatcggggccgtatcgtttgatgtgacccacgcccgttcacactttgacgatggtgataatgaaagcggccagtcctggcgttttctctactccaaacgttttgatgataccgacaccagtttccgtctggtggggtaccgttattccacggaaggctattacaccctcggcgagtgggcatcgaggcaggacaacagctctgatttctgggagacgggcaaccgccgtagccgcgtggaaggaacctggacgcaatcatttggccccggttttggcaacatttatctgacgttaagccgtcagcaatactggcaaacggatgaagtcgagcgcctggtgcagtttggctatagcaatagctggcggcgaatttcgtggaacgcgtcgtggaactataccgactctgcgaatcgttcttccggcagcaataataaaaacgacaacgatgacagcgatcacgaacagatattcatgctgacggtttccatcccgctttcaggggcgaaggagagcagctacgttaactactcgatgacgcaaaataatcataacgacagcacaatgcaggctggcgttggcggcacgttgctggagggccacaatctttcctataacgtgcaggaatcctggaccagtacgccggaggatacctatggtggtaacgccagcatggggtatgacggtacttatggttcagtaaacggcggttatgcctggagccgtgattcacaaacgctgaactatggcgcccgcggcggcatcctggttcacagcggcggtgtgaccttctcgcaggagttgggggaaaccgtcgcgctggtggaagcgccgggtgctgatggccttaccgtagaaaacacgactggggttgctacagactggcggggctatacggtgaaaacgcagcttaacccgtacgacgaaaaccgcatggcgattgacagcaactattttgccaaagccaatattgagctggataacacggtagtcaatctggtgccaacgcgcggcgccgtggtgaaagcggcgtttgtgacgcatgtcggttatcgcgtgttgtttaatgtgatgcaagtgaatggcaaacctgcgccgtttggcgcgatggcgtcggcggagctggattccggaacggtaaccgggattgtcggcgataacggcgaactctatttatcggggatgccggaaaacggtcatttcactctaagttggggcggtgatgaatcaacaacatgtgccgttaattatacgttaggtcataaaacagagaatgctgaactggtgcagcaagccgtcacttgccaataaggaatttaattatgcgcttatggacaataatattattttcatgctttatggttcttatttcgcctgtttgccgggctggcgatggcatttgtcatgcggttaaagggacttatatttataaccttaatctcaatgacgcccggattcccgcagaaaaaaataaagccggaacagaggtcagggatctggagacattaacatcgtcagaatcatataaagttggctgtagctgtttgacccatttttcatcgacgtttcgtgaagtctattataccgctcgttcgccgctgagtattgataccaccagaaatggttacacctactatacgcttaacgataacctaagtattgcaacgtcgattgctgttcttggacgaggctttattgcggttccctttgaggctgaacctaatgtagtaaaagatgggatgaattgttataccgataccgttgagggcaatctcgcaacgttatataccgggtcggaggtcaaggtctctttccttatcaataaaccgtttgtcggtcaggttgccattcctggcacgattgtggctaatttatacggggggcttgatgccagctcctcgactgccagtaccgacaaattggcggaagtcagaattgttggcgatatcgtggcgccgcagagctgtgaaattgattccggccaggtgatagaggtgaatttcggtaagatcccggttgcggatttctcgacaacgcaaggcaccgctgctgcgggtcataaagtgactaaaacggtacaggtgaaatgtaccggaatgttggatgagaatatcgtctattcgacatttaatgctgatcccgttgattccagcgcaaatatgatgaaagttctgggtaatgatgatgtcggaattatgatttatgacaaatgggatcggatggttaaggtgacaggcggaaaaatggatatggatatgggcgtcaataatggcggcgccgagactaactcattgactttttctgccgcgcctgccagcgcgacgggagcgcggcctcaacctggtacatttgaagcttacgccacgatcacgctggaaataacgaactaatctaattacaaaataagtcatatcaatgaactacggccctggctcaatccaggtggatcggaaatcaaaccatcccaggttattcaggtggatccccctggcccggtcggggcttttgagtcgcatccagtggtgaaaaagcggctgtagccagcctgaacgggtggtttccctgaccagttgttccgcgctgatggtttcggcatgccactgggtttcccattgggccagcagcgcatcatccccaccgctgatggcgtggcgcagtaaaggggagcccagtagccatgtaccgacgttccactcttcgggaatggggaaattgaccgtccccagccagagatccacattggttttgccattcgcccagtcatcataattcagctcaacgccctcaagtaaaatgccctgctggcgcatgatctcttgcataatatccaggagcattggaaattcagggtgctgatcgtgataggccagacgaagttttgcgtagggcgacgacgagataaaaggtgaacaggccgggcccgcctcaatagtatgaaaccaggaggacagcaggctgccgcccggtacccagaaggggcgaattgcctcactcagatgctggagtaaggcgtaagggctgagagtttcccgcagccagcggcgatgttcggcggtatgccagtgcggggagcggctgtcgcataataaaaaatatcctccacgctcaagaaacatctcgcgcaggttgtcagaaggtttgcctgatacctggctaagccgtccggaaacgtaatcctcatcgctcaggctggaactgagccaggctgccgtgtcgttatccgacagcgattccgccaggttgtctgtctccgttaaattcggccagataaagacctccacttcatccagcagcccgcgcaggccgaaatagtggtcaaaggccttcatttgcagatgaaagccattgttttccaccacctcataagggccagtccccacaggatgtgccgggaaatcagcgcgttgtgtatggtcaggcggtaggatcatggcatcaatatggctgagcagcagcggcagtcggttatccgggtgcgccagcgtaatttcaaggctcagcggcccggtggcctgaatggtctgcaagtgcgagaacaacggcagcttagcgctgcgggtcagtgaagcgataaccgcgtcgatcgtcagctcctgaccatcatgtcagaggacggcggggcgcagataaaaacgccagcgcagtggatcaatctgccgccagtggtgggcaagatcggcttcgacttcacctttttcctcatttatgcgcgtcaggccgctaaaaatctgcctgaccagatgctgctcagagcgacgcaacggtatgccggggcacagcgacggcattgtccggtaataggggatgcacagccgctgatagtctgcccgcacgctatagcccagttttgagcgcagcagttgcgccacctggtgcttatttttacccagcagctgaatggcctgatcaacatgaccagactccagcaactgctccgccttttcgcttaacagctgttctggtttatagcgcaggtgaagccgggcgcgatgcccacgtccggcctgtgattgccagatgagccactttgcctcctgcatctgaagcaacagattacgcatatgccgccgggtgcagaacaacacatccgccagctcctgtagcgtcacgctaacgggcttatcgccatagtgctggagtagctttaagtatttttgttcagtgtgccgggttgccataaaagatgaaatttcccgaacgggaatgagcaatttttaatatcccctttttagccgatgattttctctatcgcaacttctatgaggattcatcatgacaaagcgcattaataaagacactcaggtctgcatgtccctggctgcacgcccaagtaacttcggtacacgctttcacaactatctgtacgaagcgctggatctcaattatctctacaaagctttctcgccgaccgatcttacgcaggccattagcggcgtgcgcgggctggggatacgtgggtgcgcgatctctatgccatttaaggaagcctgcattccgctggtggatgaactggatgcttccgctaaggcgtacaacaccgattacattgcaatagctcgcttgctggcgaattacaaggtctctcccgaccaggtgtttgctttgcgtggcagcggtggtatggcaaaggcggtggcctgcgcgctgaaggatgcggggtttacccgtggttatattgtcgcgattgatgaagcgtcaggtaaacaactggccgaactctatggctatgaatggcgcccggataccgacggtattgaagccgatttgttaattaacgccacgcctatcggaatggctggcggtaatgatgccgacaaactctcttattccgaacaagaagtggataaggcgagcgttatctttgatgtggtggcgctaccgcccgtcacgccgctaatccgctacgcccgtgaacgcggtaaaaccgtgattatcggttccgaagtgtttgctattcaggccgtggagcaatttgtcctttataccgggattcgcccggatgacgcactgttccagaaagctgcggcctggtcacgtctgtaacattttttcccgctttttctttaaattaaaagaacagggtatcctactatgactaaaaaaattgttgctgtgacggcctgtccgacgggcgtcgcccatgcctttatggctgccgaagcgctggaaattgaagctcgcaagcgtggtgactggatcaaggttgaaacccgcggttccgtcggggcgaagaacacgctgaccgcggaagagatagcgcaagcggatgtggtgattatcgcggcggatattgagctggatctgtcaggctttgttggcaaaagactctatcgcaccagtaccggcgcggcgctaaaaaagagtgcgcaggaaatggataatgctttcaatagcgccgaggtctatcaggggagtgccgggcgctcttcttcagctagtaaaacagagctacccggcgtttataagcatttaatgaccggcgtatcccatatgcttcctttggtggtggcgggagggttatgtatcgcgctctcttttgtcttcggtatccaggccttcaatgagccgggcacgctggcggctgcgttatttcaaatcggtggtaaggcggcctttgcgctgatggtgccggtactggctgggtttattgccttctcaattgccgatcgtccgggtctggccccggggcttattggcgggatgttggccagcctgtgcggtgctggtttcctgggagggattgtggccggttttctggccggttacagcgtacggtttctggcgcaaaatattaagctgccagcgtcaatggaagcgcttaagccggtactggttctgccgctactgtctacgctgattaccggcctaatcatgatttacgtggtgggtggccccgtttctgcggtgatggaagggctgacgacgttcctggggaatatgacctctacgaatgctatcttgctgggaatgttgctgggcgcaatgcaaggttttgaccttggtgggccggtgaataaagctgcgtataccttcggcgtcggtttactggcttctcattcctatatgccgatggcggccattatggcggcagggatggtaccggcattagggatgggcgtcgcaacctgggcggccagagcgaaattcactgcctctgagcatgaagcgggtaacgcatcctttatcctggggctgtgctttatctctgaaggggcgattcccttcgctgcgcgtgacccgatgcgcgtcatcccttccacgatggtcggtggcgcaatcgccgggggactgtccatgtatttcggttgtacactgatggcgccacacggtggtctctttgtcctggcgatcccgcatgcggtagaacatgtgatgcagtacctgctctcgattgccctgggcacgattgtctgcggcctgatgtacgcgctgttgaaaccgtctgcggttgcgcaaacagtttaattcatctccccctgcaggctggtctggtgtctccccgggccagcttttttatttccattgtcatcaaaccgtcataatcaagacatataactgtcatcaatttgtcctattttgctcatcgtagcaactcaaacaacgatttaccgaaaccgtgcaggagacattatgaaagttatgcgtaccactgtcgcaactgttgtcgccgcgactttatcgatgagcgcgttctctgcctttgcagcagcaagcctgacaggtgccggtgcaacgtttcctgcgccggtgtatgccaaatgggcggatacctaccagaaagaaaccggtaacaaagtcaattaccaggggataggctcttccggcggcgtgaaacaaattaccgcgaataccgttgattttggcgcttccgatgcgccgctgtctgacgaaaaactgaatcaggaaggcctgttccagtttccgacggtgatcggcggcgtggtgttggcggtgaatattccaggcctcaaatccggcgaactggtgctggatggtaaaacgctgggtgacatctacctcggtaaaatcaagaagtgggatgatgaagccatcaccaaactgaacccaggcgtgaagctgccctcacagaatatcgttgtggtgcgtcgcgctgacggttccggtacctccttcgtgttcaccagttacctggcgaaagtcaacgacgagtggaaatcgaaagtgggcgcgggttctaccgtgaactggccaaccggtctgggcggtaaaggtaacgacggcatcgcggcatttgtacagcgtctgccaggcgctatcggctacgttgaatacgcttacgctaaacagaacaacctggcctacaccaaactggtttctgccgacggcaaaccggtaagcccgacggaagagagcttctctaatgcggcgaaaggcgcagactggagcaaaaccttcgcgcaggatctgaccaaccagaaaggtgacgatgtgtggccaatcacctccaccacctttatcctggtccacaaagcgcaaaagaaacctgagcagggtgctgaagtgttgaagttcttcgactgggcctacaaaaatggcgctaaacaggcgaatgatctggactacgccagcctgccggataacgttgttgatcaggttcgtaccgcctggaagaccagtataaaagacagcaacggtaaggcgctgtattaattaacgaattggcggatggcgctacgattatccgccctacggtttcgaccgcaggcccacgttgtaggccggataatcgtagcgccatccggcaggggcaacgtcgtaaaatgcgtttaatggaaagagtaatttatggctgcaaccaagcctgcttttaacccgccgggtaaaaaaggcgacatgattttcagcgcgctggtaaaactggctgcgctgattgtgctattgatgttgggcggtattatcgtctcattgatcatctcctcctggccaagtattcagaaatttggtttctcatttctttggactaaggagtgggacgcgccaaacgatatctacggcgcactggtgcccatttacggcacgctggtaacctcctttatcgcactgctgatcgccgttccggttagtttcggcattgccctgtttttaaccgagctggcgccaggctggctgaagcgtccgctcggcatcgccattgaactgctggcggcaattcccagtatcgtgtacggcatgtgggggctgtttatcttcgcgccgctgtttgcgacgtacttccaggagccggtcggcaatattctttccaacattccgtttgtcggcgcgctgttctccggcccggcctttggtatcggtattctggcggcgggcgtcatcctcgccatcatgatcatcccctacattgcggcggttatgcgcgacgtcttcgagcaaacgccggtaatgatgaaagagtccgcttacggtatcggctgtactacctgggaagttatctggcgcatcgtgctaccgttcaccaaaaatggcgtgatcggcggcattatgctggggctgggccgtgctctgggtgaaacgatggcggtcacttttatcatcggcaacacctaccagctcgacagcgcgtcgctgtatatgccgggcaacagcatcacttccgcgctggccaacgaattcgctgaggcggaatcgggtctgcacgtggcagcgttgatggagctggggctgatcctgtttgtgatcacctttatcgtcctggcggcgtctaagttcatgattatgcgtctggcgaagaacgagggagcacgttaatggctacgcttgatatgcagaacaccgcgcagctcgcggaattccgtcgcaagatgcaggcgcgtcgccgcatgaagaaccgtatcgcactaacgctctcaatggcgacgatggcatttggcctgttctggctgatctggattttgatgtccaccatcacgcgcggcattgatggtatgtcgctggcgctgtttaccgaaatgacgccgccgccgaacacggcgggcggcgggctggcgaacgccctggcggggagtggattattgattctctgggctaccgtattgggtacgccgctggggattatggcgggtatttacctggccgagtatggccgtaaatcctggctggcggaaatcattcgctttattaacgacattctgctttccgcgccgtcaattgttgtggggctgtttgtttacaccatcgtggtggcgcagatgcagcacttctccggctgggcaggggtgattgcgctggcgctgttgcaggtgccgatcgttatccgtaccactgaaaacatgctcaagctggtaccggatagcctgcgtgaagccgcttatgcgctgggtacgccgaagtggaagatgatctccgcgattacgctgaaagcctctatctccgggattatgaccggtattctgctggctattgcgcgtatcgccggggaaacggcgccattgttgtttaccgcgctctcgaaccagttctggagcaccgacatgatgcagccgatcgccaacctgccggtgaccatttttaaattcgcgatgagcccgtttgccgaatggcaacaattagcctgggcgggcgtgctgattattaccctgtgcgtactgctgctgaatattctggcgcgtgttgttttcgcgaagaaaaaacacggttaaagacattgtaggcctgataagcgtagcgccatcaggcattattttacggcgtggcggatgcggcgctggatgaggaaaagagtgaaatgagtatggttgaaactgccccgagtaagattcaggttcgtgatttgaacttctactacggcaaattccatgccctgaagaacattaatctggatatcgcgaagaatcaggtaacggcatttatcgggccatccggctgcggtaaatcaacgctactgcgtaccttcaataaaatgtactcgctttatccggagcagcgcgcggaaggtgaaattctgctggatggcgacaatattctcaccaacacccaggatatcgcgctgctgcgcgcaaaagtggggatggtattccagaagccgacgccgttcccgatgtccatctatgacaatatcgcctttggcgtgcgtctgtttgagaagctgtctcgtgccgatatggacgagcgcgtgcagtgggcgttgaccaaagccgcattatggaacgaaaccaaagataaattgcaccagagcgggtactctctctccggtggtcagcagcagcgtctgtgcattgcgcgcggtatcgccattcgcccggaagtgttgctgctggatgagccatgttcagctctggacccgatctccaccgggcgtatcgaagagctgatcaccgagctgaaacaggattacaccgtggtgatcgtgacccataacatgcagcaggcggcacgttgttccgatcatacggcgtttatgtacctgggcgagttgattgagttcagcaacacggacgatctgttcaccaagcccgcgaagaaacaaacagaagattatatcaccggtcgttacggttaattcaggagtgcgtaatggacagtctgaaccttaataaacatatttccggccagttcaacgccgaactggaaagcatccgcactcaggtaatgaccatgggcggcatggtggagcagcagctttctgacgctattaccgccatgcacaaccaggacagcgagctggcgaagcgcgtggtagaaggcgaccatcaggttaatatgatggaagtcgccatcgatgaagcctgcgtgcgtattatcgccaagcgccagccgacggcgagtgacctgcgtctggtgatggcgattatcaaaaccatcgccgaactggagcgcattggcgacgtggcggataaaatctgccgtaccgcgctggagaaattctcccagcagcaccagccgctgttggtgagtctggagtcgctgggccgccacaccgtgcagatgctacacgacgtgctggatgcgttcgcgcgcatggatctcgacgaagcggtgcgtatctaccgtgaagacaagaaagttgaccaggagtacgaaggtatcgtgcgtcagctgatgacctacatgatggaagactcgcgcaccattcccagcgtgctgaccgcgttattctgcgctcgttctatcgagcgtatcggtgaccgttgccagaatatctgcgaatacatcttctacttcgtgaaggggcaggatttccgtcacgtcggcggcgatgagctggataagctgctggcggggaaagatccgaaagagtaaatctcattcttttgcccggtggcgctgcgcttaccgggcctacaggtacagatgctgtaggccggatgagcgttagcgccatccggcatttcagttaacgcgtaatcttccacccgcgcgctttccacaatcccggcaactgcgccaaatcggtaaatgtcgtcacgttagggtgatcgatcggcttgttatgcggatcggcgcagaaataaaatacttccattcccgccgcaattcctgactgcgcgcctgcgctggaatcatccaccagaatacacttctcaacattgaccttcatggcgttcgccgcatggagcatcagcgccggatcgggcttccagcgttgaatatcgtaaccgctaaacagcaaatcgggaaaatgatgcaacatgcccagtttacccagcgaatgctgcatcttactgaccggcccgttggataccacgcacatgggcgtcttaatgctctccagcagggtatttgtgcccgcgatcgcttccagttcggtatcgaacaggcgcgccacttccgcgcgatacaccggctccagctccgcctttgccagcgcaacgccatgctctttactgatggtatcgataatttcgtagagctttacgcctttaaagcgtctgaatacttccgtgagctcaagcgtaatgccgaactgccggaacatagtgacataggcgcgcgagcaaattacttcactgtcgaccagcgtgccgtcacagtcaaaaaacaccgcttcgatttgggacatgtcatttccattttaacaagtttaacgtttacgtaatgctgaatgaggggacgcaatcgttgccgtactaacaaattgagtgaaaaaaattaccacacaactgcgccaggtgtcgcattttggtataggataacggcgaattttccctcctttctccggaaattgataatgagtcaacaacacaccacccaggcttctggtcagggtatgctggaacgcgtgtttaaactgcgcgaacatggcacgacggcacgaaccgaagtgatcgccggttttaccactttcctgacgatggtttatatcgtttttgttaacccgcaaattctgggcgtagctggcatggacaccagcgccgtctttgtgaccacctgtctgattgcggcctttggcagtattctgatgggcctgttcgctaacctgccggtggcgctggcgcccgcgatggggctgaatgcgttctttgccttcgtggttgtgcaggcaatgggactgccgtggcaggtaggcatgggcgccattttctggggcgctgttggtcttttattgctgactatcttccgcgtgcgttactggatgattgccaacattccggtcagcctgcgcgtgggcatcaccagcggcatcggcctgtttatcggcatgatggggctgaaaaacgccggcgtgatcgtcgctaacccggaaacgctggtcagcatcggcaacctgacttcgcacagcgtgctgctgggggttctcggattctttattattgcgattctcgcttcgcgcaacattcatgcggcggtgctggtgtccatcatcgtcacgacgctgcttggctggataatgggcgatgtgcactacaacggcattgtctccgcgccgccaagcgtcaccagcgtggtagggcatgtcgatttggcaggctcgttcaatcttggcctggcgggggttattttctccttcatgctggtaaacctgtttgactcctccggtacgctgattggcgtgaccgataaagccggcctggcggatgagaaaggcaaattcccgcgcatgaagcaggcgctgtttgttgatagtatctcttccgtcactggcgcatttgtcggaacctcttctgtgaccgcttatattgaatcgtcttccggcgtttcggtgggcggtcgcaccggtttgacggcggtggtagtcggtattttgttcctgctggttatcttcctgtcgccgctggcgggcatggtgccgccttacgcggcggcgggcgcgttgatttacgtcggcgtgctgatgacctccagcctggcgcgggtaaactggcaggatttaaccgaatcggtcccggcgtttattacggcggtaatgatgccgtttagcttctcgatcaccgaaggtatcgcgctgggctttatctcttactgcgtgatgaaaatcggtaccggtcgcctgcgcgaccttagcccgtgcgtagtgattgtcgcgctgttattcgtgctgaagattgtgtttattgacgcacactgatgaaatgaaccctcgccccatcggggggagggtgtttaactaacttacgctttaacgcgctgaatatactcgccaaatgcggtcaactgaccggtcaaatgatctaacgttccctgatccaccacttctccagtctgcgggtcgactttattctgaatcacgccgcccataaattccggtttattcatcaccatcgcatcaaggaacaccagaatctggcgcagatgatactggcagcgcgcgccgccaatcgctcccattgagctggtctggataagaacgggcttacccgccagcggctgctcaggcagacgggatagccagtcgatggcatttttcaggccgccgggaacggaatagttatattccggcgtcacaatgacgacgccgtcggcgttgcgaatctgctccgccagcgcctctacgctggctggaaatccctcttcctgctggatatcggcgtcatacagcggaatatccccgattgaaggcagcggcgataccgtcattcctgccggcgcgactttaggcagcgtacgcgccaccatcccgttaaaggaacctttgcgtaaacttcccagcaatgtaaccacattcagcatttcagacatacgtgccccttttttcattatgaacgattaagcgtatacgatttggcggcggggagttgggcgaatcgcatcagacggccggttggctcattggcgcgcgtctggatatcgggcaggcttttccagcccagtttgccatcgaactcccacacttttaatttttctatcgctggcgtaacggttacggaccataccagcacatcttccgcatcgcacacggcttcaagctgcgtgacatgcgcgcacttcaggcgtccggcaacgggtaaaagttgcagctcccgcggatcgtcattcatgacatcgccggtgagttttaacacgctctggcgcaatgtaatgagttgcgctcgcgcttcgttgggatcgttttgattggctacccataagttttcattacgggagaaagggtggcgttcgagcgaatgcggatggtgaaagccgcgggaggtgcgctgtaattccatatccagcccgcactctccttcggtggtcaacgccacgccaaccatatttccggcgtaggagatagaaaaacctggcagatttttgtcacgaaacgcgggtttacctttcgcctgaataatgatttccggcagctcgctaattccgtacagcataaacatcagttcggcaagaaggcctctggaggcgagaaaacgcgttcgtcggtgagcaggcaggtttctggcttcaatatggcaagacgaagagagacgaattgaaaccaactgtccctccgtaagtatccctctggcaaagtgagtcgccatttttcgctccgtgattaatgggccgtgataatgacgagagtaacattaacgtaaattatggacaggttttacgcgctaaaaattcaatttcagaaggttctttaatcagacggtgacatttctggtaagagtaaggttaatttatcaacgcaggtggtcagataaggcgacggcagagcgtgttgatagcctgtcgtagccacacaatcttgggattatgactattacgtttgtgccataatagggtaaacggcaccatcagcttttcccgctgttgcgcatcaaaaggcagggggcgcgccactaacggtagctggtggagctgattgtagtgctggcaatagcgcggcgcggttgctatcagggtgtgacccggctgggcggccataaagagcgactgctcgaaccccggcaggcttaacgcgatatggcgtttgcgtcccatttcttgtaggacatcatccagcgcccaggtatcgctttgctcccagcaaatactgatatgcgggtagcgcagaaaagtgtccagatcccacgtttcgcgcagtgccggatgatcttcctgcagccagacccacggtaaatcgctaaacagtacctcaaagtcaatcgcgagcggcaacagactgatcaactctcgcgagcggggatggctttcgcgtccggtaaatccgatatcgactttcccgcgcgtaatcgcctccagcgagtcataatcccagttgcgaaccttaatggtagcctgcggatagcgctgataaatctgctgcgacagtgaattaaacataatcatcatcagcggcgactctgccgccaactcaaattttaaaccgcgcggcgtttgatgatgtggcttatcaagcagttgattccccatctgcatccagtccgccagactttgctccatactgaccatcagcggcgtcggcgccaggcccagcggcgtattgacgaacagcggatcgtcaaaccatgcccggagtttcgccagcgatttgctgaccgcagagggcgttacgttcatccgttttgcagctttagtgacgctgcgctcctgcatgagtaactgtaggcataacagcagattaagatcgagactggtaagggatttcttcatgctcggctacggacctgttgggcgcgacggagaagatcagcagaatactcactatgctacaaccaatcagaatcccgatcagcatattcatcgcgctgataccgagtattgccgccagccaaatccacagtgatgaaccgcaaacctgagcgatacccagcgtggaactggccactccggcgcgcagcgaaaacggccccagcgcctggctcatcgcgacgccaaaaccaaccgagaatccggcgcagataagcgtcaggccaaagagcgtgacggtattggtatgagcaaggcttaacgtcacgccagccgtcaaaaacagcccctgtgagacgagcattaaggttcgcggcttaaataacccaagcgcaaaaggggtagaaaaagagacgaccatgctgacgcctgcggtgagcgccatggtaatggcatagtcgccacggctaaatcccatcacctccatcagcagcactggagaggcattgacgaaggtcaggatcaccgacacgctaagggtggtgatcgctagtcgactaacgaaaaaacggttaaccagcgactcggcggcggacgacgatggtgataaatcgcgtggagccagccttgccgggcgcgtctcgcgcaggataaacagtgataacaggcccaccataatgcccatcgtggacatcgtatagaacagactttgccaggggaaacgaagcataatcaaatgccccatcaccggggcgagtaccggcacaatacaggtaatcccattcaataatgacagcactttcgcccggcgatgctcgtcgagcgtgtcgcgcagaatggcgaacgccaccacatagcagccgcctgctcctaccccctgaagaaaacgcccactcagaaatagcgagccttccgacgcccgtgaacaaagcagtgaggccatcataaagacgatcgcgccgacgatcgcgaccggcttgcggcctgactggtcggctatcttcccggcaaacagcatggccgtcgccattccggccaggtaaacggagaaggcgatatgcaactgcgcctcgctggcgttcagatcggcggctatacgcggtaaaccgaccagatacatatcaataccagcaggatagagtaaaaccagggcaaaactacacagtagaaaacgtttcatagcggcctcacgaaaagtgtggcgctaagaatacggggcgacgttgcgcgagacgagttgtcatttggacaacagtgatttccgcatgggaaatcattgctgccggatggcggcgtaaacaccttatccggcttacgggttttgtaggcccggtaagcatcgcgccaccgggcaacacaacgttatttaccgatacagaagctggagaaaatccgtcccagcaggtcgtcggaggtaaactcgccggtaatctcgcttaagctttgctgcgccaggcgcaactcttccgccagcagttcccccgcccatgcgcctaatagctgcgctttgccctgttcaagatggttagcggcttccgccagcgcctgcaggtgacggcggcgggccaggaagccgccttccatattggtatcaaaccccatgctctgcttgaggtggttacgcaacacgtcgacgccttcgccggtacgcgccgagaggcgaaccagtgagtgaccgtttacttcactaatacccagcgtttcgccggtgatatccgccttgttacgtaccacggtaatcggtagatttttgggcagacgggcgataaagtccggccagatgtcggcagggtcaacggcgtccgtcgtggtgccattcaccataaacagcactcgatcggcctgttcaatctcctgccaggcgcgttcgatgccgatacgctcaacttcgtcgttggcgtcgcgcagtccggcggtatcgatgatatgcagcggcatcccgtcgatgtggatgtgctcgcgcaacacgtcgcgcgtggtaccggcgatatcggtgacaatggccgcttcacggcctgccagcgcattcagcaggctggatttcccggcattcgggcgtccggcaatcactaccttcatcccttcgcgcagcaggctgccctggcgcgcttcggtgcgcacggcgtcaagatcggcgatgacgccattgagctgcgcttcgattttgccgtcagagagaaagtcgatctcctcatccggaaaatcaatagccgcttcgacgtagattcgcaggtgagtaagtgcttccacaaggtggttaacgcgggcggaaaatgccccctgtaacgagtttagcgccgaacgcgccgcctgttcggaactggcatcgatcaggtcggcaatggcttccgcctgggctaaatcgagcttatcgttgaggaacgctcgctcggagaactcgcccggtcgggcaattcgcacgcctggaagcgtcaggatacgttttaacagcaggtccagaatcaccggaccgccgtgcccttgtagctccagcacatcttcaccggtgaaggagttcgggccggggaaccacagcgcaataccctgatccagcgcgctgccgtcaacatctttaaacggcaggtagtcggcatagcgcggcttcggcagcttgcccagcacctcttgcgcaacgtcgcgcgccttcagaccggaaatacgcaggatacccacgccaccgcgtcccggtggggttgcctgggcgacgatagtgtcgttatggctcatggttagtctcaactttgttgcaataaaaaaaggcggtcatatgaccgccttttgattgtaggcctgataagcgttagcgccatcaggctgaccggcgcgccttgccggatggcggcttcgccttatccggcctacaccgaatcaggattttttcttctcgcggctatgcaggccacgcttctccagaccacggtaaatcagctgctgctgaatgatggtgaccaggttgttgacgatatagtacagcaccagacctgacgggaaccacaggaagaacactgtaaagatgaccggcataaaggtcatgatcttctgttgcatcgggtcggtcacggtggtcggcgacatcttctgaatgaagaacatcgttacgcccatcaggatcggcagaatgtagtacgggtcctgtgcagacaggtcatgaatccacagcgcgaacggcgcatgacgcagttcaatggaacccatcagcatgtagtacaacgccaggaagataggcatctggatgatcagcgggaagcagccgcccagcgggttaaccttctccgctttgtacagggccatcatctcctggctttggcgctgtttatcatcgccaagacgttcgcgcatcgcctgaattttcggctgcagcatacgcatcttcgccattgacgtgtactgcgctttggtcagcgggtacatgataccgcgaacgataaaggtaatgatgataatggagaagccccagttgcccacaaagctgtggatccacttcagcaacttgaacagcggctgagagatgaaccacaaccagccgtagtccacggtcaaatccaggtgcggtgcaacagccgccattttatcctgaatttccgggccgacccacagggtgctggtcatcgcgccagtctggcctggctgtaccagtaccggctgcgctttatagccgatagcgacaatgccgttacccagattggcggtgtagaaattgttggtgccgtcgttacgcggaatccatgcggtagcgaaatactgctgcaacattgccacccaaccgcctttggagctgacgttgaggttttcgttatcggcaatggtgtcgaatttgtatttctcatacttctcatccggcgtggagtacgctgcgccgcggaacgtatgcaacgcaaagttgctactgccggtgtcgcgatgaggaggcaggttgacggattgttttaactgaccaaaggtggagacttccagcggtttttcgccggtgttctgcacgctatagttcacgttaaccgcataatcgccacgcttaaagacaaacgttttggtaaacgtgttgcctgcggcgtcagtataagtcatcggaacctgcagttcgttctgaccgtcggccagtacaaacgcatctttctcgacgttgtacagcggacgcgggccgttcgccgggttatccgggccgtcgcggcctgtcaggccgctttgcgcctgatagataaactgcggggtggtttccagcagctggaacggttcgttggaacccagttctttcgggtaagccgggagcaaggcctgctcgacatcaccaccacgggtgttgatagtcaaatcaagcacatcggttttcaccgtaatcattttcccctggccactggctggtacgccctggtcggcggcgctacccgctgcggtggtcgttgtctgcatggtctgttgagtctgaggttgcggatttttatcctgctcccaggcttgccagatcatgaaagacacgaacagcaaagcgatgactaaaagattgcgttgcgaatccatcgttagtgttctctggtatcaaatggtccgggcgggacgggatcgtcaccaccagggtgtaaagggtggtattttaatacgcgtttcaccgtcaaccaactgccttttatcactccaaacctgcgcaatgcctcaattccgtagcttgagcacgttggcgtgaaacgacaatgcggcccaagcagcggactgatcaggcgttgatagacccgaataagggctatcaggacccgcgagtcaggcgacagtggcggcgccataatttttccaacgcttccgagagagcacggttatcgaggtcggcaaccccttttttcgccaccaccacgaaatccattgcaggaagttcatgctggcgcagacggaagctttcacgcgtcagacgtttaatccggttgcgttcatgcgcacgtcgaacatttttcttggcgacggtaagaccgatacggggatgccccagcgaattcaggcggccgaggatggtgatttgcggcgtgccagcccgttgaggttgctggaagacgaatgtgaaatgagcgggagttaacaaacgtaactccctgggaaatgcgagcttaaccactcaggggttagctttattacttggaaacggtcagacgagcgcggcctttagcacgacgacgtgccagaacctgacgaccatttttagtagccatacgagcacggaagccgtgagaacggttgcgcttcagtacagacggttgaaaagtgcgtttcatggcgatttctacctaaacttgaataaattcactgacttttgcgtatacccgaacaaactttgaacgacttacgccacagtgtgggtgattaaagaggccggattgtaataattgtacactccggagtcaattctctttccttactttcccgcgattttccacgcctttttgtgcggaaaataagcagcgttgacgccatatgacgggcattgcgcgacgggtggagaattatacggactgccaggtaaagcgcaaggatcgccctggatctttatgcgatcttttaggcgtctgctcacctttacatattaattttttcaatatgcgcgcgaaagcgtacaggagttcccctggatcgattacacttatcctttcctggaaagccctgtggataaatcgggaagaatctgtgagaaacagaagatctcttgctcagtttaggctatgatccgcggtcctgatcgtttcaaacgatcctggtcaggcatgaacacgaaatctttcagactgcgtgaagtcgcgatcgtttgaaagatccgtgaaaaccgcagacagcggttagtgcgtcacccttcatgcagggtcttatcgacgtgcgccaacaatcattaatgtatcagcctttgtcatttatcgacttttgttcgagtggagtccgccgtgtcactttcgctttggcagcagtgtcttgcccgattgcaggatgagttaccagccacagaattcagtatgtggatacgcccgttgcaggcggaactgagcgataacacgctggctttgtatgcgccaaaccgttttgtgctcgattgggtaagagataagtacctcaacaatatcaatggattactcaacacattctgcggcgcggatgccccacaactgcgttttgaagtgggaacaaagcccgttacgcaaacgctaaaaacgcctgtgcataacgttgtcgcgcctacgcagacaacgacggcgcaaccgcagcgcgtagcgcccgcggcccgttcgggctgggataacgtaccagcgccggcggagccgacctaccgctccaacgtcaatgttaagcatacatttgataacttcgtcgaaggtaaatccaaccaactggcgcgcgcggcggcacgtcaggtggcggataatcctggcggcgcctataacccgttattcctctatggcggcaccggtctgggtaaaactcacctgctgcacgcggtgggtaacggcattatggcgcgcaaacccaacgcgaaagtcgtgtatatgcactccgagcgctttgtgcaggacatggtaaaagccctgcaaaataacgccatcgaagagtttaaacgctactaccgctccgttgacgcattgctgatcgacgatattcaattcttcgccaataaagaacgatcccaggaagagtttttccacacctttaacgctctgctggaaggcaatcagcagatcattttgacgtcggatcgctatccgaaagagatcaacggcgttgaggatcgtctcaagtcccgctttggttgggggctgacagtggcgatcgaaccaccagagctggaaacccgcgtggcgatcctgatgaaaaaagcggacgaaaatgatattcgtctgccaggcgaagtagcgttctttatcgccaagcgtctacgctctaacgtacgtgaactggaaggcgcgctgaaccgggtgatcgccaatgccaactttaccggccgggcgattactatcgactttgtgcgcgaagcgctgcgcgatttactggcgttgcaggaaaaactggtcaccatcgacaatattcagaagacggtggccgagtattacaaaatcaaaattgcggatctgctttctaagcgtcgatctcgctcggtagcacgtccgcgccagatggctatggcgctggcaaaagagctcaccaaccacagtctgccggaaatcggcgatgcgtttggcgggcgcgaccacactaccgtacttcatgcctgtcgtaaaattgagcaactgcgtgaagaaagccacgatatcaaagaagatttttcgaatttaatcagaacattgtcgtcgtgatcctatgaaatttaccgttgaacgtgaacatttattaaaaccgcttcagcaggtcagcggcccgctgggcggtcgtcctacgctgccgattctcggtaacctgctcctccaggtagcggacggtacgctttctctgaccggcaccgatcttgaaatggagatggtcgcgcgcgttacgctttctcagccgcatgagccaggcgccactaccgtgccggcgcggaaattctttgatatctgccgcggcctgccggagggcgcggagattgccgttcagttggaaggcgatcggatgctggtgcgttctggccgtagccgcttctcgctgtctacgctgcctgccgccgatttcccgaatcttgacgactggcaaagcgaagttgaatttacgctgccgcaggccacgatgaagcgcctgattgaagcgacccagttttcgatggcccatcaggatgtgcgctactacttaaacggtatgctgtttgaaacggaaggtagcgaactgcgcactgttgcgaccgacggccaccgtctggcggtgtgctcaatgccgctggaggcgtctttacctagccactcggtgattgtgccgcgtaaaggcgtgattgaactgatgcgtatgctcgacggtggcgaaaacccgctgcgcgtgcagatcggcagtaataatatccgcgcgcacgtcggcgactttatctttacctcgaagctggtggatggtcgtttcccggattaccgtcgcgtattgccgaagaatccggataaacatctggaagcgggctgcgatatcctcaagcaggcgtttgcccgcgcagcaatcctctcgaatgagaaattccgcggcgtgcgtctgtacgtcagtgagaatcagctcaaaatcaccgccaataacccggaacaggaagaagcggaagagattctggacgtgagctatggcgggacggagatggaaatcggctttaacgtcagttacgtgctggacgtgctcaatgcgctgaagtgcgaaaccgtgcgcattatgctgacggattccgtatccagcgtacagattgaggatgcggcgtcacagtcggctgcctatgttgttatgccaatgcgcttgtaaagaatatcgggctatcttacttgttattctggctccgggcagtgctcgcacaaaatacgaagtattttggacgtcttatggacggcccgaagggcgagcgcagcgagcaatcctcacgtactccagtacgctccggttgctgtgcgctggccgtaaccagactaactgcgccgataacgccctggttatgagttgatatgtcgctatccagactgctaatcaaagacttccgcaacatagaaaatgcggatctcgctttatcccccggctttaatttcctggttggcgccaacggtagcggcaaaaccagcgtgctggaagctatttatacgcttggccacggtcgggcgtttcgcagtttgcagcctggccgcgtgattcgtcatgagcaggaagcgtttgttcttcacgggcgcctgcagggcgaagagcgtgagacgtcgattggcttaaccaaagataagcagggcgacagcaaagtccgtatcgacggtaccgacggtcacaagatcgcggagctggcgcatttaatgccgatgcagttgattacgccggaggggtttactttactcaacggcggccccaaatacagaagagcgttccttgactggggatgctttcacaacgaagccggattcttcaccgcttggagcaacctgaaacgattgctgaaacagcgtaacgccgcgctgcgctaggtgagccgttatgagcaattgcgcccgtgggataaagagctgattccgttggcggaacaaattagtacctggcgggcggagtacagtagcgctatcgcacaggacatggcggatacctgtcagcagtttttacctgaattttccctgacgttctctttccagcgcggctgggagaaagagacagactatgcggacgtgctggagcgaagctttgagcgtgaccgtatgttgacctacaccgcgcacgggccgcataaagcggactttcgcattcgcgctgacggcgcgccggtggaagataccctgtcgcgcggtcagctaaagttgttgatgtgcgccttacgtctggcgcagggcgagttccttacccgcgaaagcgggcggcgctgcctgtacctgatagatgattttgcctctgaacttgacgatgcgcgtcgcggactgctggccagccgcttaaaagccacgcaatcgcaggtctttgtcagcgcaattagcgctgaacacgttatagacatgtcggatgaaaattcgaagatgtttaccgtggaaaagggtaaaataacggattaacccaagattaaatgagcgagaaacgttgatgtcgaattcttatgactcctccagtatcaaagtcctgaaagggctggatgcggtgcgtaagcgcccgggtatgtatatcggcgacacggatgacggcaccggtctgcaccacatggtattcgaggtggtagataacgctatcgacgaagcgctcgcgggtcactgtaaagatatcgtcgtgactattcacgccgataactccgtgtccgtaacggatgatggccgtggcattccgaccgggattcatccggaagaaggcgtctcggcggcggaagtgatcatgaccgttctgcacgcgggcggtaaatttgacgataactcctataaagtctccggtggtctgcacggggtgggcgtctcggtagtcaacgctctgtcgcaaaaactggagctggttatccagcgagatggcaaaattcaccgtcagatctacgagcacggcgtgccgcaggcacccctggccgtcactggcgataccgataaaaccggcacgatggtacgtttctggccgagccacgaaaccttcactaacgtcactgaatttgaatatgagatcctggcgaaacgcctgcgtgaactgtcattcctgaactcaggcgtttccatccgcctgcgcgacaagcgcgatggcaaagaagatcatttccactacgaaggcggcatcaaggcgtttgttgaatatctcaacaagaataaaacgccgatccacccgaatatcttctatttctccaccgaaaaagacggtatcggcgtggaagtagcgctgcagtggaacgatggtttccaggaaaacatctactgctttaccaacaacattccgcagcgcgacggcggtactcacctggcaggcttccgtgcggcgatgacccgcacgctgaacgcctacatggacaaagaaggctacagcaaaaaagccaaagtcagcgccaccggcgacgatgcccgtgaaggtctgattgcggtggtttccgtaaaagtgccggacccgaaattctcctcacagaccaaagataagctggtctcttccgaggtgaaatcggcggtagaacagcagatgaacgaactgctgagcgaatacctgctggaaaacccatctgacgcgaaaatcgtcgtcggcaaaattatcgacgccgcgcgtgcgcgtgaagcggcgcgtcgcgcccgtgaaatgacccgtcgtaaaggcgcgctggatttagccggtttgccgggcaaactggcggattgtcaggaacgcgacccggcgctgtccgaactgtacctggtggaaggggactccgcgggcggctctgcgaagcaggggcgtaaccgcaagaaccaggcgattctgccgctgaaaggtaaaatccttaacgtcgagaaagcgcgcttcgacaagatgctttcctcccaggaagtggcgacgctgatcaccgcgctgggctgcggtatcggtcgcgacgagtacaacccggacaagctgcgctatcacagcatcatcatcatgaccgatgcggacgtcgacggctcgcacatccgtacgctgctgttgaccttcttctatcgtcagatgccggaaatcgtcgagcgcggccacgtttacattgcccagccgccgctgtacaaagtgaagaaaggcaagcaggaacagtacatcaaagacgacgaagcgatggatcagtaccagatttccatcgcgcttgacggtgcgactctgcacgcgaacgctcatgcgccagcgctatccggcgaagcgttagaaaaactggtctctgaatataacgccacgcagaaaatgattggtcgtatggagcgtcgcttcccgaaagcgctgctcaaagagctggtgtatcagccaactctgaccgaagccgatctttctgatgagcagactgtaacgcgttgggtgaatgcgctgattaccgagctgaatgagaaagagcagcacggcagtcagtggaagttcgatgttcatactaatacggaacagaatctgttcgagccgatcgttcgcgtgcgtacgcatggcgtggataccgattatccgttggatcacgagtttgtgaccggcgcggaatatcgtcgtatctgcacgctgggcgagaagctgcgcggtctgattgaagaggacgcgttcatcgaacgcggcgagcgtcgccagccggtaaccagcttcgagcaggcgctggagtggctggtgaaagaatcacgtcgcggtctggctatccagcgttataaaggtctgggtgaaatgaacccggatcagctgtgggaaaccaccatggacccggaaagccgccgtatgctgcgcgtgaccgtcaaagatgcaattgctgccgaccagctgttcactacgctgatgggtgatgccgttgagccgcgtcgtgcctttatcgaggagaacgccctgaaagcggcgaacatcgatatttaacctgccttaatccccggcccgccgctggctggccagggcatcatgatgttcatccatatatctgaatagaaactctttaaagcgctgcgtggcgggcgtttgcgcgcgccacgcatggaaataaaggttcatattgcgccgcagcggaggcgtgagcgaacaggtcgctaattgatagcttttggcgtaatggcgggaaaaggtttcggcgatcaccacgccttcacactgcgccgccagcgacatggcggtcgccatatgttccaccgtcattttgggcttaatgcgcacgccagcggtcgcggagatcatcggaacggattcgttgccaacggcgatcagctcttcgctctgaatctcttcccagcgcaccgtttttttatgcagccgatagtccggatggcagtacagggcgatttccgttgtgaacagcgtttgtttgtcgatttccggttccagcggccgctccgggccgataccaaaatcggcttctcccaacataatgcttttttgtaattgcgacatgggcttatcaataagctgtacgtgggtatgcggatgctgccgcttaaaggcatggatgatttgcggcagaaaagcacaggcgatcagcggcgcgccgaccacccgcaccagggattttttgatctctttcaggtcgcgggcataattttcggcccgttgaaactcttcaacaacccgcatggcggcgggtaaaaacttttcgccgtcgggcgatagcttcaccacgcgcgaagtgcggtcgaaaagggaaacctccatctggctttccatttcgttgattaaaccgctaacagctccctgcgtgatgcacagatatttgctggcggcggtaaaactacgcaaatccgcgacggccagaaacgcgcgaaattgccggatagttaaattcatttgccacctgtgttacccctttactgagaggattttatctcaggctggataaggtcgcgttgatacgactcgcaaatacagggtgtctgcctgcggcgcaggcagacagttggcttattttacggtgatggttggtgattttttcatggtttcttcggtcagttcctggccgatgccgggaagctccgagacttcgtacatgccgttcttcggcaggtagttgtatttacaggtctgtgtattcggctccagcagcgcataccggtgcagttcgtggatgacgaagttagggattgcggtttccatatgcagcgccactgctgtggaaatcggcccgccgcaaacgtggatttgcaccgttttgtcataaacatgcgccatatcgcagattttcttcacttcggtgatgccgccgcaggtacaaatatcgggctggatcacgctcaggctgccgttttccaggaaaggacggtatccccagcgccagtaaatgcgttcgccagccgccagtggaatattaattttatcagccacttgtttcatttgtccggggtttaacggcatgaccggttcctcgtagtagaagatgcccagctcttctatcatgcggccaaactgaatcgccgaggtggtatccgtaaaggcatgcatttcggcgatgatatccacgtccgggccgactgcatcgcgaatggcggccatacggtcgtagcccagacgcaggattttatcggtgagaggcccgttgaggttttgctggttccagttgccgtggcgatccattgcgacggtatccacttttatcgcgtcatagccttcgctgacggcggtcagcgccgcctgtgcatactgctccggctcggtcagcatatctttatcgctgccgtccccccaaccaaactgtaactgactggcgtaggttctgattttctcgcggcttttgccgccaagcattttatacagcggcacgccccacgctttgcctttgatatcccacagcgcgatatcgataccgctcattgctgcggaaaagatgccgccgccgccttgtccccagaacgtctttttgagcatcttttcccagatggcttcgttattcatcgggtccatgccgatgataatggcggctaaatcttttgccatgccgatgcctgcggaggcgccgacgccgtaggccaacccgacttcgccaaaaccggaaatgccctcgtcggtattaatttttaccaccaccggacgccatttgctggtggcggacgcaaaatcattagcaacatcaataatatcaatgctggtaattttcatcatttactccttgtgattaatattttttaatcgttaaaacgaatgcagataccacggcgatagcgctgatgaaaaccagacataataagccgccggtataggttcctgtaatagagataaataaaccgataaatactggtgataatgatgacaggccgttcgcgacgccgttcattacgccgctggcggcggaaatagatttcccggacaccatcccttgtaataatgtccacgcaacaggcgtacccatcgtgcaaaaagcgacggcgaaggagagtagtaccgctgacatatatttgtgttcggttattgtgccgaaatagatactgataccggcgaaaaacattaacaccattaatatgggggcgctgcgtcctattttatcgacgaagacgcccgcggcggctttggaaaatatcgacaagacaaacggcagcgacgctagccagcccatttctgcccagctaaatcctctggctgatttaagataggttggcagccaggtaatcatcccccagtacaggcattgcagacacaggtaccacagcaccagcaaccagtagcaatagttggtaatcaccggttttacccgcaacataaaactttcgctgctgcttgcgctttccgtttcctgcccggctttgatataagccagttcctgctcgctgatacttttatgttgttctggtttatcagcaacatatcgccaaagtagccagagtgggattaacccgagagcggcgcataaaaagaagttggaacgccagccgtgggtgcctatccaccaggtgaaaaaaggcatcgcaatggcgggcgcgaccgactggccgacgatccacgctgcgtttgcccggccacgctcctgcttcggaaaccagtttttaataaatacgctttgcagcggataataaaaaccctctccgatacccagtaatatgcggcaaataataattaatgcaaacgatgtcgcaactccgccaataattaaggcgatggtccagattaggatacaaagcatcatcgcttttctcggaccaaggtagtcgccaagtggtgataatacaacattagcgataccataagcggcaagaaaaacggtcatcatcatgtcaatttgcaatggcatgccttcaatacccatataggctaagaagggttcgtttgcggctaataccgaaacattaacgcggtcgagataggcaatgaatattccaataaacagacaggcaacgattaaaaatcttttcctgccaggcggggcggtaagggccatcgacatttggcgatctcctttaattaaattaacatcatttttgtttatttttacaatagggtgattcatgaccagggtaacaatatcgatgagattagaaaaacggtattttctgtttgattaatgaggttatctaataaatgtgagtattcactgcacaaaactcgccttctgtactgagcaaaagaggaaggtttgtcttattctttagccccgtttatccctgactcttttgctgttttttgagcggaatcgcgttagcatgagtcaggactcatttaatgcggggatttcatggctattaaactcattgctatcgacatggatggcacccttttgctgcccgatcacaccatttctccggcggttaaaaacgccattgccgctgcgcgtgaaaaaggggtaaacgtggtgctgaccacaggccgtccgtatgcgggtgtgcacagctatctgaaagaacttcatatggaacaacccggcgactactgcatcacctacaacggggcgctggtgcagaaagcaggggatggcagtacggtagcgcaaacagcgctcagctatgatgactaccgttatctggaaaaactatcccgtgaggtgggttctcacttccacgcattagatcgaaatacgctttataccgctaaccgcgatatcagctactacacggtgcatgagtcgtatgtggcgaccattccgctggtattttgtgaagcggagaagatggacccgaacactcagttcctgaaagttatgatgatcgatgagcctgccgttctcgaccgagcgattgcgcgtataccggcagaggtgaaggaaaagtataccgtgctgaaaagtgcgccgtacttccttgaaatcctcgataaacgggttaataaaggcaccggcgtaaaatcactggccgaggcgctgggtattaagccagaggaggtgatggcgattggcgatcaggaaaacgacattgcgatgatcgaatacgccggtatgggcgtggcaatggacaacgccattccgtcggtcaaagaggtggctaactttgtgactaaatcgaaccttgaagatggtgttgcctgggcgattgaacaacatgttctgtcctgattcactccggcccgatcgccgtcgggccgatagttccactcatgaagctaatgtgttgcaacaaagacgttgtagaaaatagttttttatttcaaaagattaattcgcacagaaatcccgcccaccaggcgacgattactatattctccctcctcctttcgatccggcggcgcttctcgccagaataaacgcttcatcattatgaaaaaacgctcccttttgctgttggcgctgcccgctatggctttttctacctgggcggctaccagccccccggcgaacctgtcgccggtttatagctatcaggatgacgtcccatctgctgccacaccgccagtcgcgacaacgccggtggcaaagcctgccagtacatcagtgttgccttttctgggtgatgaagcccgaaagcgtggctatgagcttcccgagccatttggcctcaatattaactacatgaatattgggcagaatattaacgttgatagcatcaactttaatggcctggctttaggtcccaacgggggaattccattagataacgcgtttaaaattaacgtcggtcatacccgtgaaaagagcaagaccgaaacggtcaagctggatgtctggctgctgccatttatgaatgtgtacggcctggtgggctataccgatggtcattccgtttcgcaaattggtgttgggttgatgacgaaaaatggccacgtttttcatcccgccgatctgcaaaacctcaagtttaaactcgactttaaaggcactacctatggtatcggcaccacgctggtcggcggcgtaggtaactggtttaccgctgttgatgctaactacacccagacacagttcgatattcttgatggcagcatcgacgcctttaccgtctcacctcgcgttggttaccgttttaccaccccgggtatagataagatgcatctgccgtcgggcaagctaaacgtctgggtcggcagcatgtatcaggatgtgcagcaggagtttaaaggcagcctcgacgacctgaccatgccatcagcgacgctacaaaggctggtgagtatggctaactataacaataacggccgctttgacgtcaaacagcatctgcaatcaccgtggaacatgctgctgggcgctcagtatgaaataacccgccatttcaacgttaccaccgagtttggctttgccgagcgcaacagcttctttgtggccggtgagtatcgcttttgaaccgctgccattgccgacagttgctttgcgtcgccggtgtgctgtccggcgtggcgcaggcggcgctgcccagccgcagtcaggtggacggctggctacaacaaatgggggatagcgatacttacgatgccgccaaaggcgtcaactggggagtaatgcccgggccattttatacccctgaactggggctgggcatcggcaccgccattgtcggtatgtatcgccccgatcctgccgataaggttagccagatatccacgctgtcgctgagcggctattttagctccacgggcgctttcggcgtaagcctgcaaaattacgcctttttcgcgcaagatcgctggcgtttcttccttactggcgcattgagcgacacgcccacttactattgggggcagggttttgccgccggtgataaagacagccataagcaggcctataccgcgcaggtgctggatctgcaacccatgctgtatcgtcggctggtcaacaatatctatcttggcgttggctggacgctggatgtacagcacgccgcgcaaatcaatgaggacgatccgcccagaattcaacatacagcgcagggcggttcttcactgagtaacggcggtagcgttgagattagttgggacgaccgtgattttatgcctaacccacgcaaaggacagtatgccacccttcgctatacccacttcgcgccagacatcggtagcgatacgcggttcgatgaataccagttgcactacagtcaataccacgccgttgatgataaagacgtgctggcctgggaagctgacggtgcctttacccagggctacgtgccatggaatatgctgccgctgctgggcagtaaccatcgtatgcgcggctattatgaagggcgctatcgcgataaaaacgccgtcagtggccaactggaatatcgccataagttgagctggcggcatggcgttgtcggttgggtgggagcgggcaccatgggatcgtctttgcaccatctggatgacgggcgatggctgccttctgcgggcgtgggctatcgctttgagttcaagccgcgcgtcaacgtgcggctggattacggcgtgggcaaaggcagcagcggtttttattttcaggtaggagaggcattttgaggactatcgttcgggttatctttctggcgctgctgtttctggcggggagcgcccgcgccgccttaccactgacgctctatctgtccacgctcccaatgcctgctgccagtgaagcctggccaacgatgccgccacagccgctgccaaaggggttgcgtccgtgttgcgcttttggttacgacctgcatgccgagctgctgggactgccggttccgttttatcagttaaataacgtcgtgacggtagactcgctggggcatcatcagtacaacgaccatctgtactcgggcgtggcaaacctgatcggccttagcggtgagaataacggtattgtgtataccttgcgtggcggattcatcgacaccgcacatgtgcgggataccgctgatatgacagtgtatatcttcagccaactactaccaaagctggggcaggcttttacgctgaatctgggcgaggagctggccgaacggcgtctggtctttactgcttttacccctccggtcgatgcacgcgagcgttacacgctggccgcctggctgtcggcgcatctggcgttccaggtggcggagtggcacgaaatcgcccaatggtacggtttcgagtccgttcgcggattttctgagggagtatcggccttttcgccggaagatctctattctaacctcgcgggtgcccgtctggcggcgtctttaattgtcgacggccagacgaaaacgcaagagatgtacaacacggcgatggaaactgcgctgcggcaagcgctgacgcagctggcagcgcagccggcgcagatcacccgttttcagtttgatatgcttgatggtcgttggtggaacagccagcggcgggtaccggaaaaatatctggtgctgcatcgtaattatcagatgggcgatgaccgcctgccgaccgcggttcctggcgagataacgtcgctattgccgctgagcttgccccatcgctggcgcggtatccagcttagcacgctggcgcagctacaattgtggcccagcgaggatatggcgcagctaccgcctcccgcgcactattacagcgaaaaagattttgccgccctggcggagcaggcacggctacaggacgaaaaaacacagaatcattaaacaggcggtagccgtaggctatttccctcttataccctcggcgtactgttttatgtcctgataactggcgatgtgaaacgcgtcgtttggcgagccggaaatcatcatggcgaaggatgaccggctatccatgcgtcgagcgccgtcactccctgcgtcacgatagttttaatatctatatcgctaagcggttgcaattccagctcccgacaggcttcggttgcctgcgtcatccccaggctggcgcagccgctttttaatttatgcgccagccgcttaatgttaacgtcgtcattcatggcgcgcgccgcctcgatctcctcgactaaaggcagcgcgctgtctttgaataaggcgacccattgccggagcttttccgggccgacagacgccatatcgccggcaagctgatgttcattcaacatcacccgcgcgttgtgagatttgccctgtaaatagtgcgctatcatgcggtaaagctcctcgcggggaacgggcttttgaataatcccgcagaaaagaccggcggtacgctgacgaagattatcgtctatcacatgcgcgctaaaaccaatgcgtttcatggcgggatacaggctcatcaactgctgcgccagggttaagccgtcataatccggtaaatcaaaatccaccagcgccacatcaaagggctcgccttcggctaaacagcgtagcgcgtcattcgcgctttcagctactgagaccttcacccctttacccgtgagcatttcagcggtaatacgctgcgtcagcatattatcttcaatcagcaacaggcgtagtccgttaagatttaccggttccctgaacgcacttttgcttgcaggtttggggtggcgaaccggcagttgtaagcgaaaacaactgccaacatgaagcgtactggtgacggttagcgtcccgcccatcgcctctgccaggctggcgctgatagccagccccaggcccgtcccgccccggcatcctgtcgcctgcacaaacggtttgaaaatagccgtcagcttcgcttcagggataccgcatccggtatcttcaacctcaataaaccagctctgatcgtcgcaaaacgtgcgcagcactatgctgccgcgatcggtaaatttcgccgcattacttaaaagattaatcacaatttgacgtatccggcgcggatcgccttgtagcgtggaagggagttgctcgctaaagtcggtgatgagcgccacctgcacgcggctgtgcattaaatgcagcgcgctattcaacaattgtcgcggttcaaacggttcctcgctaatggaaacgttggtgccgcctacttcaatcgccgagtaatcaagaatatcgttaagaatcgccagtagcgattcgcctgaatcattaatggcctgtaaatcgtcgcggtagtttgccatgagcggtttatcggccagcaattgtaccgtaccgagaatgccgtaaagcggcgtgcgaatttcatggctcatggcggcaaggaacgtcgatttcgcctcgttggccttttccgcttcggcgcgcgcctgccggtgttccagcaccagcgcatgaagctccgccgtttgcgatcgcacctgttccgccaaatcctcacgatggcggttcaatttgcgcacgttggcgcgaaacgcttccatcagacggctgatggtatccagttcgctgacgccagccgcctccggaaacggcgagtcaatatcgccctccagtagccgctgtaaggcctgcgtttgttgcgccagcgggcgggatacggaacggtaaaccactcgccaaagaataaaacttaatgagcacagcgccaggatacctaagatcactaaccctatttgcccacgctgactggtgtgtgtaagacgcgctaacccagcctcgtttcgtttttcgatggcgttcaccaactgcgacacttccgtactgaagcgggtaaactgaaagaggttattggccataagcgtttgaagctggtcgcggatggcgttttccttacgaaacagggtaaccagtgtcgtgtactggtttattttccccagcgcgtcggcgatttgggcgcgaacggtaggatcttctatacgctgctggcggcgggataaaattttaaccaactgattaagtttttcatcggtttccttggcatcgctcagcccttgcgcgtcttttaaggtcacaatgagctgcttaaaccgcagggcattgacccgcaactcattcatctgattcacatactcaaggtcgatatcaatcagtcggtcaagcgcgcgttcagcctgatcccctttaccgctttcgataagatcgtaaataccggcctgggtggcgcccgcagatgtcgctgcattattggcttgaccgtgagcctgggcggcaatgctttccgccgcctccgcaatctggcggcttaactgctgttgctgtgcgcgcagcgtgagaatttcaccgaccagcgttccctgctgcccaagcgtttgcgcaatctctttttcttgccgggcgatggccgaggtattaaacccctgctcgcttaatgcctgcaaaagatggttaattttaaggctttgcgctttcagcatcttcccctgcgccagccaaacgccctcgctgtcggcattggtcagattttgcgcggaaaagagctcgtaagcgctggcttcgcttaactgcctggccatattcatcgtggggagcagcgcttgcgtattggtttgctccacctgactaatgacgcgcaggcttatccagccgatcacggtgctgagcagggtgagtgccgccatcagagcgaaggccagccataatctgtgggtcagtgaaggcgttgacatttatgcgccgcgggtgaaatgggttgagttgccgccggaaaaaccattaggataaaaccttgttgctggtggggctatcatgcgcacgcttatttcgttcttttttttgataatcatcgtctcgaatgtagaaacggcgtcagccgaaaccgggttgctacactggacgcgcgccgatcgggcgattccctggcggcaaacgtcagtcaatgcgagtaaaccctggaaactgtgcgcattataccccagcctgaaagattcttactggttgtccgtcaactacgggatgcaaaaagcggccaaattgtatggcgttgatttaaaagtgctggaagcgaatggctatcggcaactggcgacgcaacaacagcaaatgacgcagtgccgggagtggggcgccgacgctattctgcttggcagcagtaccgatcgtttcccggagctggaacgatatgccggtaatgtgccggttattgaactggtgaacatgattcacgatgccagcgtcgcaacccgcattggtctgccgtggtttcagatgggttatctgccgggacgtttcctggtgcagtggagcaaaggaaaaacgcttaacgttttactcttcccggggccggaagaagccggcggcagtcaggagatggtggcgggttttcgtcaggcaattaaaggcagcgccatcaacattgtggatatcgcctggggcgataacgacattgaagtgcagcgaaacttactccaggaaatgctggaacgccatccggacgccaatgtggtcgccgggtcggcgatagcggcggaggcggcgatgggcgaagggcgaaatttgacgactccgctcacgatcgtctcattttatctgacgcatcaagtttatcgcggtttaaaacgcggccatatcctgatggcgctcagcgatcagatggcctggcagggagaattagcgataacgcagtcgattaaggtcttacaggggcaaccggtgcctgaaaatatcagcccgccggtacttattttgacgcataacaacgccgacagcgcgcgcgttcgccgttcgctatcgcctccgggatttcggcccgtctatctgtatcaatacacctccgaggctaaaaagtagccttcgccatgctgtgtgaccagcagttccggcgtaattttatgacgtaagtggcgaaccaggacatcaatcgtgcggagatccggggtctctacgcggcgggcggaaagcattcgcagcagacgttcgcgatgcagcactttgcctgggttggtcacaaaggccagcagcagctcgtactccgcgcgcgtaagcttaatggcttcaccgttgtgctccagcgtgtgattcatcacgttcaggcagtagccggaaaacatatagcagttttcactggcattttgcggcgtggggcgggccagatcgatacgccacaaaagatttttcacccgcactaccagctcgcgcagttccagcggcttggtgacgtagtcgtccgcgcccatctccagcccgacgatgcggtcgatttggtcgcaacgccccgtcaccagaataatgcccaccgtggagcgttcgcgtagcgccctggtcagcatcaacccgttttcatcggggaggttgatatccagcaggatcagcgaaacgtgctcatgctccatgatgtcacgcgcaggcccgcgccgctgtcggtcaccgaaacgcgatacccctcctgctcaaaataggcctgtaacctggcctgagtaacaggttcatcctcaacaataacaatgtgatgtgacatcctgcgcgcggtctctttctgttcatatctgttcatatattgccgtatcccgttcatcctgaccagtgacgctgttcatatttgcggaataagatctgcgcattaaaccatataattacaggggctattatgcgaaaactctggagagcgttactcaggccaagcacccgttggtcgatactggcgctggtcattgtcgggattgtgatcggcgttgcgctgatcgtgttacctcacgtcggtatcaaactgaccagtacgacagagttttgcgtcagctgccatagtgtgcagccggtgtatcaggaatataaacagtccgtacatttccagaacgcttccggcgtacgcgcggaatgccacgattgccatatcccccccgatattccaggcatggtgaaacgtaagctggaagccagcaacgatctttaccagacatttatcgcccactcgattgataccccggaaaaatttgaagctaaacgcgccgagcttgccgagcgagaatgggcgcgcatgaaagagaataactccgcgacctgtcgttcctgccataactacgatgcgatggatcacgcgaaacagaacccggaagcggcgcggcaaatgaaaatcgccgcgaaagaaaatcaatcctgcatcgactgccataaagggattgcccaccagctaccggatatgagcagcggtttccgcaaacagtttgatgaactgcgcgccagcgccagtacgcataatgacggcgatacgctctattcgctggatatcaagccgatttacgccgctaaaggcgataaagaaccggcaggttcgctgttgcctgcttctgaagtgaaagtccttaaacgggacggtgactggctgcaagtgcaaatcgaaggctggacggagacggacggtcgccagcgcgtgctgacgcagttgcccggtaaacgtatttttgtcgcctcgattcgcggcgatgtgcaacagcatgtgaaaacgctggaagagaccaccgtcgcggcgaccaatactcagtggagcaaattacaggcaaccgcgtggatgcaaaaaggtgacatggtaaatgacattaaaccgatttgggcctatgccgactccctctataacggcacctgtaatcagtgtcacggtgcgccggacaaagcgcactttgacgctaacggctggatcggcacgctcaacggcatgatcggtttcaccagtctggataagcgtgatgaacgtaccttgttgaaatatctccagatgaatgcgtctgataccaccaacacgccgcacagcgataagggagaacacaatgaaaaataaggactcgttacacgtctctcgtcgacgttttctggcgcagcttggcggcttgacggtggcaggaatgctggggccgtcactactgacgccccgtagcgcccgcgcagcggatgccgttgcgccaggcgccgcgacgaaagagggtatccttaccggttctcactggggggcgattcgcgccacggtggttgacggtcgatttgtggcggcaaaaccgtttgaacaggataaatacccgtccaaaatgatcgccggtctgcccgatcacgtccacaacgcggcgcgtattcgctatccgatggtgcgcgtcgactggatgcgcaaaggtcatcaaagcgacacctcgcagcgcggcgataatcgttttgtgcgcgtctcctgggatgaagcgctggatctgttctatcaggaactggagcgggtgcaaaaaacctacgggccgagcgcgttactgacggcgagcggttggcaatctaccggcatgttccataacgcctccgggatgctggcgcgcgcgattgcgctacatggcaatagcgtcagcacgggaggggactattcgaccggcgcggcgcaggtgattctgccgcgtgtggtgggttcaatggaagtgtacgagcagcaaacgtcatggcctctggttttacagaacagtaaaacgattgtgctatggggttctgatatggtgaaaaaccagcaggcaaactggtggtgcccggatcacgatgtctatcagtactatgaacaattaaaagagaaggttgccagcggcgctatctcggtcatcagcatcgacccggtcgtcacctccacgcacgattatctggggcgcgataaggtcaaacatatcgccattaacccgcagacggatgtcccgttacaactggcgctggcgcataccctgtacagcgagaaactgtacgataaaaatttcctcgataactactgcgtcggttttgaccagttcctcccctatttgctgggcgagaaagatggacagcccaaagatgccgcctgggcggaaaaactgtgcggtattgacgccgacaccatccgcgcgttggcgcggcagatggcgggcgacagaacgcaaatcatcgctggctggtgcgtacaacgtatgcagcatggcgaacagtggtcatggatggtcgtcgtgctggcggcaatgctgggacagattggtttaccgggcggcggctttggttttggctggcactataacggcgccgggacgcctggtcgtaaagggatcattttaagcggcttttccggttcgacgaccgttccgccagtgcacgacagcacggattacaaaggctacagcagcaccattcctattgcgcgttttatggatgccattcttgaaccgggcaagatcattaactggaacgggaaatcggttaaattaccgccgctgaagatgtgcgtgttcgccgggaccaacccgttccaccgacaccaacaaattaaccgcataattgaaggctggcgcaagctggaaacggtcatcgctattgataaccagtggacgtcgacctgccgctttgcggatatcgttttgccggctaccacccaatttgagcgtaacgacctcgatcagttcggcaaccactctaaccgcggcattatcgccatgaaacaggtggtgtcgccgcagtttgaagcgcgtaacgactttgatattttccgcgatctctgccgacgctttaaccgtgaagcggcattcacggaaggtcttgatgaaatgggctggctgaaacgcatctggcaggaagggagccagcagggaaaaggtcgcggtatccacttaccgactttcgaggtgttctggaatcaacaggagtacatcgagtttgatcatccgcagatgtttgtgcgccatcaggctttccgtgaagatccggacctggagccgttgggcacgccaagcggtttgatcgagatttactccaaaacgatcgccgacatgcaatacgacgattgtcagggccatcccatgtggttcgaaaaaatcgaacgctcgcatggcgggccgggatcgcagcgctggccgctgcacttacagtccgtccaccctgatttccgtctgcattcccaactgtgcgagtcggaaacgctgcgtcagcaatatgccgttggcggcaaggagccggtctttattaacccacaggatgccagcgcgcgcgggatccgcaacggtgacatcgtgcgggtattcaatgcacgcgggcaggtactggcgggagcggtagtttccgatcgctatgcgccgggcgtggcgcgaattcatgaaggtgcctggtacgatcctgataaaggcggcgatctcaacgcgttatgtaagtacggcaaccctaacgtattaacgctggataccggtacatcacagctcgcgcaggcgaccagcgcgcatacgacgctggtggaaattgaaaaatataccggtcctatggataacgtcacggcgtttaacggtccggccgagatggtcgcgcagtgtgaatatgtacccgcatcgcaggggaatccgcatgattaagcagccagcgcttgctcaggaacagtacgcctgcgtatatgcatggctggcgttactctttttccgggaagtggatgatgaagggttaatacaattacagtccgcggaaatcgcggactggctggcgctgttaaagcgtcagccagcgctggcggcgtcggtggcgttactcgaacaaaaaattgccgcgcttagcctgcgtcaggatgcgcagctggagctggccgcggatttttgcggattgttcctgatgacggataaaaaatcggccttgccctacgcctcgcaatacccgcagcaggaacccggcatgattaaacatttattgcttgaagccgggatggaagtcaacgacgattttaaagagccggccgaccacttggcgatttatctggaattactcagccatttacatttttcattgggtgaatcgttccaacaacggagaatgaataaattacgccagaaaacattatcgtcattactggagtggcttccggaatttacaaataattgccttaagcatgatccctatggtttttatgctgcgttaagtcaattattgttggctatcgttcgttttgatgacggaaaagaggatttatccattgttgcggttgaataaaccctgtgacgggcatcgcaaaataaatcttacgatagtcgggggttatcatatctataggtttagccaattgtaattattgataccaatcaatatccatgatgggtttgtatttagtattgacgggtctcatgagtaaaaaaataaaatttaattaattatgccgcaataccccataaggatagtgatatgaaaaaaattaccctctatgcgacaacggttatcaccgttgggctgttatgttatttaggtttgtccgggtatgtatggtattacgacaaacagcgcagtaaaaaaagcgatgtgcaggcctcggttgtgggtgaaaataataaaatactgggttatttcagggagaaaggatgtgattattgtcatacgccttccgctgaattgcctttttattcctcttttccggtggcaaagcagctaatggattacgatatccagctcggctacaagtcgtttaacctggaggcggtacgggccgccctgattgcggatacgccggtgccgcaaagcgaactgaataaaattgaatgggttatgcaacatcagactatgccaccaacccgctatgtcgcgctgcactgggcggggggcgtcagcgataaagagcgtactgacatcctgaactggatagccgatcagcgtgagcgcaactatgccagcgccgataccgaccccgcacaccggaatgaacccgttcagcctattccgcgcaatattcccgtcgatgcgaaaaaagtcgacttaggtttccgactttatcatgatgaacgtttatccggcgacagcacaatatcctgtgcgcattgtcacgcgttaaatgcgggcggtgtcgatggcagaaaaacctcaattggcgttggcggtgcggtagggccaataaatgcgccgacggtattcaactccgtatttaatatcgaacaattttgggatggtcgtgctgcaaccctgcaggagcaagcaggcggaccgccgttaaatcctattgaaatggcctctaaatcctgggatgaaattattagcaagcttgataaagaccctgtcctgaaaaaagatttccaggcggtttatccgcaaggatttaccggggaaaatattactgatgcgatcgccgaattcgaaaaaacgttgataacgccggattccgcttttgataaatggctacgtggagatgaaaatgcgctgaccgcgcaacagaaacacggttatcaattatttaaagaaaataaatgtgcaacctgtcacggcggtatcattttaggcgggcgctcttttgaaccattgggattaaagcgagactttaattttggcgaaattaccgcagcggatattggtcgtatgaacgtcaccaaagaggttcgcgataaattacggcaaaaagtcccaggcttacgcaacgtcgcgttaacagcgccttatttccatcggggcgacgtaccgacgctggatggcgcggtaaaactgatgctgcgttaccaggttggcaccgatctgccgcaaaacgatattgacgatatcgtcgccttcctggaaagcctgaccggtgtttatacgccatatcaacctgaatatgcgcaatgacaatgatgcttgaagccagagatctgtactgcgagcgggacgagaggacgctgtttcgcgggctgtcgttcaccgtggaggccggggagtgggtgcaggtcaccggcggcaacggcgccggaaaaaccaccctgctgcgcctgctgaccgggctggcgcgcccggacggcggggaggtgtactggcagggcgagcccctgcgccgcgtgcgcgacagcttccatcgcagcctgctgtggatagggcaccagccggggataaaaacccgcctgacggcgcgggagaacctgcactttttccaccccggtgacggcgcgcgtctcccggaggcgctggcgcaggccgggctggcgggatttgaggacgtgccggtcgctcagctctcggccgggcagcagcgccgggtggcgctggcccgcctgtggctgacccgcgccgcgctgtgggtgctcgacgagccgttcaccgccattgacgttaacggcgtggcgcgcctcacccggcggatggcggcgcacacggcgcagggcgggatggtcatcctcaccacccaccagccgctgccgggggccgcggacaccgtccgtcgcctggcgctgaccggcgggggggccgggctgtgatgtggcgtgtcttctgtctcgagctgcgcgtggcgttccgccacggcgcggacatcgccggcccgctgtggttcttcctgatggtcatcaccctgtttccgttaagcgtcgggccgcagccgcagctgctggcgcgtatcgcgccgggcatcatccaggtggcggcgctgctggcctcgctgctggcgctggagcggctgtttcgcgacgacctgcaggacggcagcctggagcagctgatgctgctgccggtgccgctgccggcggtggtgctggcgaaggtgctggcccactgggcggtgaccggcctgccgctgatgatgctctccccgctggtggcgctgctgctggggatggacgtgtacggctggaaaatcatggcgctgacgctgctgctcggcacgccggcgctggggtttctcgccgcgccgggcgtcgggctgacggccggcctgcggcgcggcggcgtcctgctgggcattctggtgctgccgctgagtgtcccggtgctgattttcgccaccgcggcgatggacgcggcatcgatgcatttacccgttgacggctatctggcggtgctgggggcgctgctggcgggcagcgcgacgttaagcccgttcgccaccgcggcggcgctgcgcatcagtacgcagtagcgccccggcacgacggacattttactggtttcaggaggtcaggtgacgactatgtggaaaacccttcatcagctggcggcgccgccccggctgtatcagatttgcggcaggcttgtgccgtggctggcggcagccggcatcattgtgctggccacgggctgggtccggggctttggtttcgccccggcggactaccagcagggggagagctaccgcattatgtacctgcatgtcccggcggccatctggtcgatgggtatctatgcggcgatggcggtggcggcgttcaccgggctggtctggcagatgaaaatggccagccttgccgtcgcggcgatggcgccggtgggggcggtgtacaccttcatcgcgctggtcaccggcgcggcgtggggcaaaccgatgtggggcacctggtgggtgtgggacgcgcgcctgacctcggagctggtgctgctgtttctctatgccggggtcatcgccctgtggcacgcctttgacgaccgtaaaatggccgggcgcgcggcgggcattctggtgctggtcggcgtggtgaacctgccggttatccactattccgtcgagtggtggaacaccctgcaccagggctcgacgcggatgcagctgagtatcgacccggcgatgcgctcgccgctgcgctgggccatcgccggcttcctgctgctctttatgacgctggcgctgatgcggatgcgcaacctgattttactgatggaaaaacgccgcccgtgggtgagcgaactgatactgaaaagggggcaccggtgagtccggcattttcatcgtggagcgattttttcgccatgggcgggtacgccttttttgtctggctggcggtggcgatgaccgtggcgccgctggcgctgctggcgctgcacacggtgctgcagcgccgggccattctgcgcggcgtggcgcagcagcgggcgcgcgaggcgcggatgcgtgccgcacaggcgcaacaggaggccgcgtgaatctgcgacgtaaaaaccggctatgggtggtctgcgcggtgctggcgggcctggcgctgaccaccgccctggtcctgtacgcgctgcgcgcgaatatcgacctgttctatacccccggcgaaatcctctacggcaagcgcgagacgcagcagctgccggcggtgggccagcgcctgcgcgtcggcgggatggtgatgcccggcagcgtcaggcgcgacccggactcgctgaaggtgaacttcagcctctacgacgccgaagggtcggtgacggtgagctatgaggggatactgccggacctgttccgcgaggggcagggggtggtggtgcagggcaccctggagaagggcaaccacgtcctggcgcacgaggtgctggccaagcatgacgagaactacaccccgccggaagtggaaaaggcgatgcaggaaaaccaccgccgcccgcaacgcgctgataaggacacttcatcatgatgcctgaatacggccacgcactgctgtgcctggcgctcggcgtggcgctgctgctgtccgtttacccgctgtggggcgtggcgcgcggcgacgcgcggatgatggcgtcggccggggtgttcgcctggctgctgttcatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgtttgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgttgtccatctgcgccttctcgctgtgtctgctgggcaccttcctggtgcgctccggggtgctggtgtcggtgcacgccttcgcctccgacccggcgcgcggaatgtttatcctcgcctttatggtgctggtcaccggcggctcgctgctgctgttcgccgtgcgcgggcacagggtgcgttcgcgggtgaacaacgcgctgtggtcgcgtgagtcgctgctgctcggcaacaacgtcctgctgatggccgccatgctggtggtgctgctgggtaccctgctgccgctggtgcacaaacagctggggctgggcagcatttcggtgggggagccgttctttaacaccatgttcacctggctgatggtcccctttgccctgctgctgggggtggggccactggtgcgctggggccgggaccggccgcgtaacatcaggaaactgctgctcaccgccctggtctccaccctggtgctgtcggtacttttgccatggctgctggaagatagaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggtatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccggggggctgctgatggcgctgggcgggctgctgtgcctggcggacccgcgctaccgccgccgtaaaccattgccggaggccggatgaaacgcaacgtactgttattaccgctgctgatttttctgctgattgccgcggcgctgctgtggcagctggcgcgcaacgcgcagggggatgacccgacgaatctcgaatcggcgctgaccggaaagccggtgccggcgtttcgcctggaatcgctggagacgccgggtcagtactatcaggcggaggtgctgacgcaggggaaaccggtgctgcttaacgtctgggccacctggtgcccgacctgccgcgccgagcatcagtacctgaaccggctggccgcgcagggtatccgggtggtggggctgaactataaggacgaccgggcgaaggcggtggcctggttaaaggaactgggcaacccgtatgcgctgagtttatcggacagcgacgggatgctggggctggacctgggcgtgtacggcgcgccggaaaccttcctcatcgacggcagggggattatccgctaccgccatgcgggcgatttgaatgcccgggtatgggaaagtgaactgaaaccgctgtgggacagatacagccgggaggcggcgcaatgagactgttaccgggcatggtgatgctgatgctggcgctggttatctccgggtcagcgcgggcgaccactgacgtgatgccgtttaaagatgaagcgcaggagcagcagttccgccagctcacggagcagctgcgctgcccgaaatgccagaacaacagcattgcggactcgaacgcgatgatagccaccgacatgcgccgcagggtgtatgacctgatgcaggaggggaagagccgccaggaaatcatcgattacatggtggcgcgctacggcaacttcgttacctacgacccgccgctgaccccgctgacggtgctgctgtgggtgctgccgctggccgccatcgtggcgggcgggtggataatcgtcgcccggacgcgccggcgggtgcgcctgcgccgggagccgctgccggcggacaccccggtttgcggcgcgcgcgccgggtggggcgtttacgtgccgggggccgtcattgcgctggcggtcggcgccggcagctacgccctgaccggcagctatccgcaggtgagggcctggcagcaggcaacggcgcagacgcccgggctgctggcgcgggcgctggacccgcaggcgcagccgctgaatgaggaggagatggcgcggctggcgctggggctgcgcacccgcctgcagaatgatgccggcaatgttgagggctggctcatgctggggcgcaccggtatggtactgggtaatgccggtaccgccaccggggcgtatgcgaacgcttaccgtctggacccggaaaaccgcgatgcggcgctgggctacgcggaggcgctgacgcgctcgtccgacccggaggataaccgccgcggcggggaactgctgcgtcagctggtgagccgcgaccacacggatatccgggtgttaagcctgtatgcgttcagcgcctttgagcagcagcgctttggcgaggcggtggcggcctgggagatgatgctgaagctgctgccggcgggtgacgcccggcgggcggtgatagagcgcagtatccggctggcgcaggagaaataagaccctgacggcccggtggcgtggcgccatcgggcctggctatcccaacgatacgctaaagcctgaaagtgaagcccgtgtgcagtatgatgacgagcatcgtctcttatcaggacatcccatgaaacaaatcacctttacgccgcgccatcaccagcttaccaataccaatacctggacacctgacagccagtggctggtctttgatgtgcggccttcaggcgcgtcatttacgggcaagactattgagcgtgtcaatgtgcataccggcgacgtggaggtgatttatcgcgccgtgcagggcgcgcatgtcggtgtggtgacggtgcatcctgccgacaattactatgtgtttattcatggccctgaaaaccctgatgagacgtggcattacgatttccaccaccgtcggggcgttattgcaacgccggggggcgtgactaacctcgatgcgatggatattactgcgccgtatactcccggcgcgctgcgcggcggcagccacgtccatgtatttagcccgaacggcgagctggtgagttttacctataatgaccacgttctgcatgagtgcgatccggcgctggatctgcgtaatgtcggcgtggccgcgccgtatgggccggtaacggtgccagttcagcatccgcgcgaatacagcggtagccactggtgcgtactggttagccgcacgacgcctgcgccgagacctggcagcgatgacattaaccgcgcctatgaagagggctgggtgggcaaccgccagatcgcctttattggcgatacgctgtcgctgacgggccaaaaagtcccggagttgtttattgtcgatttaccgtgtcatgaaaacggctggaaacaggcaggcgacacgccgctgacgggaaccgaatcaacaatgccatcgccgccgttgggcgtagttcagcggcgtcttacctttactcaccagcgtgtttatcctggactcactaacgaaccacgccactgggtacgcagtaatccgcaggcgacggcgatcgcctttttgatgcgggacgataacggcgtagcgcaactgtggctgatatcgcctcagggaggcgagccccggcagttaacgcatcatgcgaccggcgtacagtcagcgtttaactggcatccgtcgggtaaatggctgggactggtgctggaaaatcggattgcctgctgcgacgcacaaagtgggaagatcgacttcttaaccgccaggcacgacaacccgccgtctgcggacgccgtcgttttttcaccggatgggcgacacgtcgcatggatggaagaggtgaaaggtttccgtcagctatgggtgacggaaaccgggcgataaatcagggaggaggcatcttcgccggggggatgacggcattggtcattttcgtctcctcctcgcttttctcgacgcgcgatcttaccgaactgtctttgcggaagatgtcccacggcagaaggatcgtatccatcacggcggtaaacggcatatccaggatggccaacgatttggtgccccagtttgtctcatcgttaccgatcatcgtagcgctggcgcgcgtgccaggataagtaccctctttaccgccggtgtgcgacatgacgcttgaacaaccgcctaataaaagcatcccattccatattatcagcgttaaccacacgttttttatcatcactcattcatctgttggttgtcgttatttgcatgatgagttatagcgatccgttgctaaaaataacatcaccagtacgtggcactgtggcggtaatcgcactttaacaatcagtgctgtcccaaccagtctatgcaatagccaataaactgcaaaaaaaagtcggattaaaatacttgaaaagtacgtattcagacccatttataagacgtagtgaatagaagggcacgcctgatgggtgttctggcaatcctggcctgtccatgatggaaggtttgacattctcgctgatttcaggagtttatgattatgcgtaactttgatttatccccgctgtaccgttctgccattggttttgatcgtctgtttaacctgcttgaaaataaccaaagccaaagtaatggcggctaccctccgtacaacgttgagctggtagacgaaaaccactaccgcatcgccattgccgttgccggtttcgcggaaagcgaactggagattactgcccaggataatttactggtggtaaaaggcgctcatgcggacgagcagaaagaacgtacttacctgtatcagggcattgccgagcgtaactttgagcgtaagttccagttagcggagaacattcacgttcgtggcgcaaacctggtcaacgggctgctgtatatcgaactggagcgcgtgattccggaagcgaacaaaccgcgccgtatcgaaattaactgattccgtcgggtcgcgttgcgcggcctgtcatcccatgctcgccgtcagggagcatattcgcacgtaaagtgtgaaggtaaaaactcgcttcttagaaggagaaatgattatgcgtaactacgatttatccccactgttgcgtcaatggatcggttttgacaagctggccaatgcgctgcaaaacagcggcgaaagccagagcttcccgccctataacatcgaaaaaagcgacgataaccattatcgcattaccttagcgttagccggtttccgtcaggaagatctggatattcaactggaaggcacgcgcctgacggtgaaaggcacgccggaacagccggaaaacgagcccaaatggttacatcagggcctggtcatgcagccttttagcctgagctttacgctggctgaaaatatggaagtttccggcgcgacgtttaccaacggcctgctgtatattgatttaacccgtaacgagccggaaaccattccgccgcagcgtatcgccattaacgaacgctccgcattaaatagctaataagctccttgccttgccccgccagagatggcggggcttttttgtgccacgaaaaagggtaagacgttgccgaagtcaggacgtctgtgcggttttgtaatatgagaatgtgcgccatgctgtatatatgccttaacggttcagtcataatccctataaattgaaatgttactcacagggaagagaagatgagatgagtgatatcgcattgacggtcagcgttctggcgttggtggcggttgtcggtttatggatcggcaacattaaagtgcgcggtgtcggctttggtattggcggtgtgttgttcggcggtattatcgtcggccacttcgtcgatcaggctggggtgacgctgagcggcgatatgctgcactttatccaggagttcggcctgatcctttttgtttataccatcggcatacaggtggggccggggtttttcgcctcgctgcgcgtttccgggctacgtctgaatctgtttgccgttctgattgtgattatgggcgggttggtcaccgcgattctgcataaaattttcgctattccgctgccggtagtgctggggattttctccggcgcagtcaccaatacgcctgcgttaggggcgggtcagcaaatcctgcgcgatctgggaacgccagtggatctggtagatcagatggggatgagctatgcgatggcgtatccgtttggcatctgcggtattttgctcaccatgtggctgatgcggctgatttttcgcgttaacgtcgaggcggaggcgcagaagcacgaatcctctctcgctaacggccattcattaattcagacaatgaatatccgtgtcgagaatccgaacctcaataatatggctatccaggatgtgccgatcctgaacagcgataaaatcatttgctcacgcctgaaacgcgatgacacgctgatggtgccgtcgccggggacgattatccaggcaggcgacctgctgcacctcgtcggccaacctaccgacctgcataacgcgcaactggtgatcggtaaggaagtggacacctcgttgtcgacgcgcggcacggatttacgtgtcgagcgtgtggtcatcaccaacgaaaaagtgctcggcaaacgtatccgcgatttgcactttaaagagcgttatgacgtggttatctcccgccttaaccgcgcgggcgttgagctggtcgccagcagcgacgctagcctgcagtttggcgacattctcaatctggtggggcgtcctgcctcgattgatgcggtagccaatgtggtcggcaacgcgcagcaaaaactccagcaggtgcagatgctgccggtgtttatcggcatcggattaggggttctgcttgggtcaatcccgttgtttgtgccgggattcccggtcgcgttaaaactggggctggccggcgggccgttgatcatggcgctaattttggggcgtatcggcagcatcggtaagctgtactggtttatgccgccgagcgccaacctcgcgctgcgtgaattaggcatcgttttgtttctggcggtcgttggactgaaatccggcggcgattttgtcgatacgctgacacagggcgaaggattaagctggattggctacggtattttcatcaccgctattccgctgattaccgtcggtttgctggcgcgaatttttgccaaaatgaactacctgacgctgtgcgggatgctggccggttcgatgaccgatccgccagcgctggcatttgccaacaatcttcatgccaccagcggcgcggcggcgctctcttacgcgaccgtctatccgttagtgatgttcctgcgtattatcacgccacaactgctggcggtgattttttggggaatgggttagcgcctgatggcgcgttgcttatccggcctatgcactgtgttaaatccaggctggataacgcgcgccgcaccggtcacacttctgctcttcttcttatctctttcctcaatgaacgtgctaatcagcgtaatggcaacgagcataattccaattttttcagttagttatcaatcttcatcgccttttttttcgtcgcaacgggtagtttttcagcttttaattcggcaataatgcctttcctggcggtggcgctgaaaaaggtcgcaactgaaatgaaaaatagcggcaatgagcgcggttgcgccgaaacacgtcaccagtgaactacagttattttgcaataagattcccttgctgcgggataatgtgaagcatatcagcaacaacgtgagtggtattctgaaaacgaacgggaatacataagaacgtaaaaggagtcgtcatgaagatttcccgcctcggagaagcgccggattatcgcttctcactggcaaatgagcgcacctttctggcgtagattcgcacctcgctgggatttctggcggcaggcgtcggtcttgatcagctcgccccggattttgccacgccggtgatccgtgaactgctggcgctactgttgtgtctgtttgcgggcggcctggcgatttatggctatctacgctggttacgtaatgaaaaagcgatgcgcctgaaagaggatttgccttatacccatagcctgttgatcatcagcgttattttgatgattgtcgcggtgatagtgatgaggctggtactgtatgccggatagtcgtaaagcccgtcggcagaacgatccgggactgcaaccggagcgtacgtcgctggcctggtttcgcacgctgctgggatacggggcgttaatggcgttagccgtcaggcactactggcatcaggcggggttcttgttctgggtgtcaatcagcgttctggcgatagtggcggtgattctttggcgttataccctgagtcgtaatttgatggatgtcgcgcatagcgatttttccgaaactcatgtcatgcgtgacaaatttttgatctccctcgcggtgttgtcgctcgcaatcctgtttgctgttacccatattcgccaacttattgcatttatcggggattttatatgacaggacgtcaggacattgtcgtgagtaatgaccagattcaggtcgtcgtaaatcgccagaatagccagcgccctcagcaactgtaccgtaacttacaacggctcggcattcgcaatgtccattttatcccattgttggaacatgaccggaacggaatgttgaccgaggattcattgtgttcagcagactgggggcggtttttaaatagcgtatttgatatttgggtacgtgaagatattcagcgtatctcggtccgcctttttgatgagacgctacagcagtggtgcggcggcaggaatggcgctaaaacgccggacaaggcgccgctaagcgctgaatgtcagaagtgctctttattacgattttgcggcggcggatgccctgagcatcgggatagccaggggaaaaatcagctttgcgagggctaccagaccttttttaactactcctcgccgcatatgcgggtgatgcgggatttactgaaacagcatcgctcgccggaggagttgatggcgatgctgcgttaacgtcacaggcctgataagcgtagcgccatcaggcgatggcgtgccggatggcgctgccgtctttccggcactaagcgagtattagcgtccttttgccaggtattgttccatttcatccttcggcaccatgccgcccccggttgcccatatcagatgcgtcgcgttgccgagctgcgtctgactgaatccatgcctttgctgatacgcgacggaggcgcaaatgcgctgtggcccggccatccccgccagagctgatggctccagtcgaattccttcctcctgcgccagccagcccagcatgtcatacattgtttgatcgtctaaggtatagaggccgtcaagcagacgctccattgcccgaccaacaaagcccgaagcgcgacctaccgccaggccgtcagccgccgtcaggttatcaataccgatatcttgtactgagatggcatcgtgcagaccggtataaacgccgagtaacatgcagggtgaatgggtcggttcggcaaagaaacagtggacgttgtcgccaaacgccagtttcaggccaaaggcgacgccgccagggccgccgccaacgccgcacggcagataaacaaacagtgggtggctggcgtcaacgacgcgtccctgctgcgcgaattgcgctttcagacgctgacccgctaccgcatagcccagaaatagcgtgcgagagttttcatcatcgataaagaaacagtttggatcggattgcgctgctttacgaccctgctcaaccgccacgccgtaatcatcttcgtattccacgaccgtcacgccgtggctacgcagcttcgcctttttccaggcgcgggcgtcggcagacatatgtaccgtcactttaaaaccgatgcaggcgctcatgataccgatcgatagccccagattgccggttgaaccgacggcgatactgtactggctgaagaattgtttaaattccggcgaaagcaacacgctatagtcatcgtcggtggttaacagacccgcctccagcgccagtttttccgcgtgcgttagcacctcgtagatgccgccgcgcgctttaatggaaccagagattgctaggtgactgtctttttttaatagcatttcaccgtcgatcgtttgcccatactctttttccagccgtttttgcatggccggaatagcgaccacgtcagattcgattatgccgccagcggcagcggtttgcggaaacgcttttgccagatacggcgcaaagcgcgccagacggtcatgggcggcgtttacgtcctgctccgtcaggccgacatacggtagaccttgtgcaagagaggtggcgcccgggttaaaccaggtggtttctttgagggcgaccagatcctcgaccaaaggataccgggcgatgagctttagtatgttttccatagtacgtctctttacgatcagatgataaaggaaagcaggaatgtgccagccagtgcaacgacagatgcgataaacgtggccgtcgtatagtatttaaacgtttcattcagcgtagcgccgcaatactgcttgaccagccagaacagggaatcggtcacgatcgtgcagccaatggtgtcggaaccgatggcaatagcgatgatctccgggctaacgtcaggatagagcggcagcatgggcgcaacaatcgcggtggcgcccatcatcgccaccgtcgcagagccgaccgccgcgtgcagaatcagcgctaccagccatgccagcagaatcgggtgcatatgcatatttgagaggatcaccgccagcgtgtccgccagtccgctacttttgagaatggcgttgaacgcgccgcccgcgccgataatcagcaggatgttcgcaatggcgccaaagccgttttcggtgtgggtaagtagcgcgctcatacccatatgctggcgcagaccgagtatgtaatacgccacaaagacagcgataaacatcgcggtgatcggattaccgataaactccagcagcgtatacaacgtgccgtctttcgccatattcagttcagcgacggttttcaccagcatcaggccaatcggcagcagaacggtaaacagcgttgcgcccagcgacggcagggtgttttcggcacgcacttcaagatccgcaaactctgtcggtacgggcttgaacggcagacgattacccagaaactttaagaacagcgggccgccgaccaatgaggccatcagtccgaccagcagaccgtagacaatcaccgagccgatatccgcccccagtttatttgcgacaaacagcgcagccggatgcggcggtaccacgcaatggacggccatcagcgcggtacacagcggaatggccagcttcagcagcgaggtatgggtctttttagcgatagaaaacgccagtgggatgagcaacacgacgcccacttccacgaacaacgtgattccgcaaatcagccccaccagtaccatgatcacgtcagcagagagccagcggcagcgctggagcgtaagcccgatgcgttccgccgcgccggaaacctccatcattttgccgaggatggtgccaagaccgataacggcggccagaaaaccgagcgtaccgcctattccgttttctatcgccgtgaccatctccagcggccctatgcccatcatcgcgccgacaaagaaactggcgagcagtaacgccaggaaggggtggaatttaaacttcacgatggtcaatacgattaacacgatgctgatcagcagcgtgctcactacccagatttgagcgtgcatatctcacctaccctgtgattaatctgttcttattggacagaaaaacagcacaccctgacaaacgatataatttgccattcacatgatgtaaattgaatcaactatgtgatttccatctaatattgcctttattttgcgatatggttcattttacttcatctatgtgcggattttttcagcgcgtttttttacacttcgggaaattaaaagatgactgaggttgccatggaaccccttcgcgatacccgaaaccgcttactcaacggctggcagttatccaaactctatacttttgaagtcgcggccagacaccagtcctttgctctggcggcagatgagctgtcgttaagccccagtgcggtaagccatcgtatcaatcaactggaagccgagttgggaatccagctatttgtccgctctcaccgtaaagtggagcttacccatgaaggcaaacgggtattctgggcgctgaaatcgtcgctggatacgttgaatcaggaaatcctcgatatcaaaaatcaggaactgtccggcacgttgaccgtgtattcacgcccctctatcgcccagtgctggctggtgcccgcgttgggggactttacccgtcgctatccgtcaatttctctcactatgctgaccggcaacgataacgttaacctacagcgtgccggcattgacctggctatctattttgacgatgcgccgtcggcgcagctcacgcaccattttttaatggatgaggcgattttgcccgtttgcagcccggattacgcccgtcgtttcgccttgcaggacaacctgaataacctgcggcactgtacgctcttacacgacagacaggcgtggagtaacgattctggcaccgatgagtggcacagttgggcgcagcattttgcggtaaatttgccggattcatccggcattggcttcgatcgttctgatttagcggtgattgccgcgatgaaccatattggcgtggcgatgggacgtaaacgactggtgcaaaagcgtctcgacagcagtgaactgattgcgccttttggtgacatgagactgaaatgtcatcagcattattatgtcaccactctgcctggcaggcagtggccgaaaatcgaggcatttattcgctggttgcaggaacaggtgtgaagatttattacgctttgccgctacacctgccgggagtgaatatgctaaatacgtgctatcaccgtggtaaaaattttagggggcgtcgtgtttaaaccgcttattgcctctctcatactgaccagcgcggtcgtctatgcgaaaccgatgcctttgacggcggcgcgctatgcgcagcagcttggcgttgggatggatgttgactgggcgcgaacggaacggggtattcgcgagtttgatccgttggtcgtgcgggattttaaggcaaaagggttaacgcatgtccgtattcgtgtggcaggcgcgccgacggaagcgcgcctcatccatttgcgtaagctggtagaggcctgcgaatactatggcgtcatacccattattgcctatcaggcggatgcgtataaaaccgatcccagcgccagccatgaaaaggagctgatcaactggtggagcgtggtcgcgcgctattttggtcagacatccccgcttctggggttcgatctcatttatgagcctgccgacaaacttaatcataatatggcgtcgctgaatcgcgtatatgacaaaaccatccgcctgattcacgccattgacccacagcggatgattttcgttgccccccgcatgcgcgccgcgccggaggatttatcggcgcttaaactgccggcgcaaagccagaactatgtactggcggagtggcacatcttcccgtggggacccctgaaaagcggcggtaaatatccgtggacgtcaggcacgacggcggaaaaagcggcgattcgggcacggattaatgccgcggttcgctggcagcataagaccggccatgcaagctgggtgggcggatgggcgccgggagagtcgataaaaatgacgccgatcgcttcacagttcgcgtttgcccgttttatggcctgcgagctgaaaaaagcgcatattccgtatgcgataaacgcggacactcagttttatgacggcgaagaaggagcgtggcgtccggcgcaggagcccctgctcaatgcgatgatcgcgccggaatgtgaaacgcccggcaaaaagccgggcgaggggaatgttaaaccgtctgtccctgatgcgatatccgtgacgccagcggcagccagcacgccaagatcagcaatcccataagggtcatcagcaatcccagactgccctgaccggtttgcggcagcattgccgaaagccacgccagtacgccggaaccaatattttgcagcccgccgaccagcgcgccagcggtgcctgcgaggaacggaaacggctccatcgcgccgctggtggccagtggaaataacatcccggcgccgaagaaaaacagcgcagcggggatgagtagcgtccagacgttcatcacgccaaaccagccgggaatccacatcataaggcctgccagcagacagcaaataactgactgccacatcagggctgagaagcgtttattcgggcgtccggcaaaccaggcgccgaagaacgccgccggaatcggcagaataaacagaatgcttaccaccatactgctgagacctaatactgctcccatcagcacgccggaacaggcttcaaagaccgcaatgccagccagcccgccgattagcatcagcaggtaacagttaaatgcgccgttgccaaacagcgtcttatagctggcgatcagccgcgtacgcggcgcgccggcggggcgggtttccggcatccagcgcgccatgctgaaggtgacgccagcgcaaagcaccagcaggaaagcgtaacacgcgcgccagttccacagggtatccagcaggccgccaatcagcggcgctaacagcgggctgaccagaatccccatatttaacaggctattggcatgacgaagttgcgttccttcatacagatcgcgcgggagcgttctcgccattactccgccaacgccggttcccatcccttgcatggcgctggcggcaatcaacaccgtcaaactatgcgtggtcatggcgatcagagtcgctaccataaaaatagacatgccgacgaggattaccgggcggcgcccaacccggtcggaaagcgggccgtaaaacagttgcgagacgccgtaggtcaggaggtaagcagccattacgctctggacggcgccttcccggacgtttagcgcttgtgccatatcggcgatggcgggaatataaatggtttgcgccatctgccctacggccaccagtaacaccaacatcaacaacaaattgacgtttctctgccttttcatttcgctgattacttttcaaaaaaagaaaaaataagaataacttgctgcgcattcccataaatgcgagaggaatctatcacaccagaaaaagaaggccagacagcaaccagcaatggcagacgaaggaacggcaggatatgtaaacaaaagcggcaacaaatgttgccgagaatgtgttacgtctgcagctgttattgggcaatcatgacagacggagtaaaatcgccccgagggcaatcccgcccgccgccaccagacgtagcccggccactttctctttaagcaacagccaggctatcagcgcgccgaataaaatcgacgtctcacgcagcgcggcgaccaccgccagcggcgcctgggtcatggcccatagcgccagcccataagatcccatagtgccaatcccgccaaaaatgccttttttccactgttgcgccagataacgcgacgcttcccgccgccgcgcaatcatcgcccaagttaacaggcaggcgccgttgagaaaaaatgaccatagcgtatagcccagcgccgtttcggagagtcttacgccggtcccgtccaccagcgtatatccggcaataaaacaggcgttagttaatgccagcacgacaccacgttgagagctggcgcggccattacaggccatcccaagtatcgccatgcagatcactgcgatgccgacctaggccatcgacgacaggctgtcgccaagaaacagaacgctaatgagcgccaccagcagcggcgcggtgccgcgcataagaggataggtctggctcatgtccgagacctgataggttttcgccaccaggacggtatacaccacctggagcgcggtagaggccgctaaaaaagggatactggcgtgagctggctgcggcgagaagggcaaaaggatcaatgccatgaccgccgcggaaccgctgacgccgatcgcggcgtagagcttatcgtttcccgctttgacaatggcgttccagctggcatgtagcagcgcggcgaacagcaaaatgcagaaaacggaaagggtcatagcatcaggcgtcgttgagggtgtcataaaaacgtaacatacccgggaagcgaaagaccagcggataaggtgaaaggggagcggttgcccgttccccttcggtgcggcttgaatctgaattacttaaggtatttcagaacagcatcaagcagttgcagtgctgcaacaatgagtttcaggataagaatggtgatatccactacgctcatacgcgtctcctgtggttaaggagcactgccagccgacgtacctttccgctgcctgttgccagctgttgcgcacgcgatcccttttgcgaggaatagtgtgcgtgttgacataacacagtgtgctcacgagggggttaaggcgctgacggcaccacccgtttcagccaggacttcgttgcgccggtttacgatgcggcccccgcataacacattgtgtcaaagacattatagttaagtgctgtataaatgaacagtaatttatagacagaacggagcttctgatccatactcaaattcatcaaaattcgcgccgaaattgcgcgttctgcacagaacgcgtatacttctgctgttgacataacacagtgtgcttcgcggctaccacccgcattacgctgtaagaacctcgcttcggcgaggttttttgttttcaggcattgtgaaacgcgtgatcatcaatcccggcgattaccggagggcgctacgcttatcacgcctatactcaaagcgtgtaaattcgtagaaaaatgtgatcgctgacgcatttttgtgcagatgaaaatttttccgttgtcatgctgaaagcgctgtgcttgtataaaacgtgttaataacaaacagacaaggcccctaatgaacccttccatgctgaacgcgaccctactaacaactgcgccatctcgcgcagtggtcgtcgtgcgtgtggtggtggtcgtcggcaatgcgccgtagggtccggaacacacacgattccaaaaccccgccggcgcaaaccgggcggggttttttgtttaagacaccttcccggaacgtcggctcagaataaaaggaatggagcatggcaagttcgggcacaacatctacacctcagcgctttacgggcgcggaatttatagttcattttctggagcgccaggggattcgtatcgtcaccggcattcccggcggttcgatcctccccgtttacgacgcgttaagccaaagcacgcaaatccgtcatattctggcgcgccacgaacaaggcgcggggtttattgcgcaggggatggcgcggacggagagtaaacctgctgtttgtatggcctgtagcgggccaggcgcgaccaatctggtcacggctattgccgatgcgcgcctggattccattccgttaatctgcattaccgggcaggttccggcgtccatgatcggtactgacgcgtttcaggaagtggatacctacggtatctctatccccatcaccaagcacaactatctggtcagaaatatcaatgagctgcctcaggtgatgagcgatgcttttcgtctggcgcagtcggggcgtcctggcccggtgtggatagacgttcctaaagatgtgcagacggcgaccattgagctggatgcgttgccgtcgccggcggaaaaatcacccccgccggagtttagcgcggagagtatccgcgaggccgccgcaatgattaacgcggcgaagcgtccggtgctgtatctgggcggcggcgtgatcaatgcgccgacacgcgtgcgcgaactggcggaaaaagcgcaactgccgacgacaatgaccttaatggcgctgggaatgctgcctaaggcgcatccgctgtcgttaggaatgctgggaatgcacggcgcgcgcagtaccaattttattctgcaagaggccgatttactgattgttctgggcgcgcgttttgatgaccgggcgattggcaaaacggagcagttttgtccgaacgccaaaatcatccatgtggatatcgatcgcgccgagttaggcaaaattaagcagccgcatgtggctattcaggcggatgtcgatgatgtactggcacagttaattccccatatcgaggcacagccgcgggaagcatggcatcagttggtggcggacttgcagcaagaattcccttgcggtattccccaggaaaataacccgcttagtcactatgggctgattaacgcggtcgcagcctgtgtggacgacaacgcgattattaccactgacgtaggtcagcatcagatgtggaccgcgcaggcttatccgctcaaccgtccgcgtcagtggctgacttccggcgggctgggcaccatggggtttggtctgcccgcggcgattggcgcggcgctggcgaatccgggcaacaaggtgctgtgtttttccggcgacggtagtttgatgatgaatattcaggagatggctaccgccagcgaaaaccagttggatgtgaaaatcatcctgatgaataacgacgcgctgggactggtgcatcagcaacagagtctgttctataaacagggcgtttttgcggcaacctatccgggaagcatcaactttatgcagattgccgccgggtttggtctggacacctgtgatttgaataacgaagccgatccacaggcggcgttgcaggctatcattcgtcgtcctggaccggcgttgatccacgtgcgcattgatgcagaagaaaaagtgtatccgatggtgccgccgggtgcggcaaatacagagatggtgggggaataagccatgcagaaacaatcacatgataacgttattctggagctgaccgttcgcaaccatcctggcgtgatgacccacgtctgcgggctgttcgcccgacgcgctttcaacgttgagggtattctctgtttaccgattcagggtagcgatcagagccgcatctggcttctggtcaatgacgatcagcggcttgaacagatgataagtcagatcgataaactggaagacgtggcgaaggtggtacgaaaccagtccgatcccaccatgttcaataaaattgccgtcttttttgagtaagttattcactttccgaatcaggcgtgatgactttgacggaaccattccgacagtgaacggcataatctgtcggtaatgggcgatcgctaatcaggacatcaaaggcagaaagcggaccaatgctggcaggcgcgacctcatcaaacagggcgtgacgcgccagcaaaattttgcgcagaccgcgctccatcgctttacgtttggcggcaagatcatccgggttaaaccagctcacgccaaaatgttcatgtacgccgctggcggaaataaacactttgcgcggattaagcgaatccagcgccgaaggattattggcatcataaaaggcatcgctcttggcccgataggtgccgccgcacagaatcgctgtggcattaggcttttcattcagcgcgataaatacccgatgcgagtagcaaatcccggtaaaggtaatatcatccggtatcatgctgatgactaatggcatttccggaccgttatcaaaaaaaaccagatcgttttcacgcaccaggccggcggccaagatcgcaacgggaaggtcgtcccgatgatgcgtctttttcgccggcagcggcatattggttgaagacgcaggcttatttaccatgacgatatagccgccgagcagcgtcagcggtaaagggtcatcatcctggctgagatcgcggcgaatggtcatcaccgaaacttccagcatccgcgcggcgtctttcagatggattcgatcggtctttttcagtaactccatcaagcgtcggatacgttctttttgcttggtctccattcaccctctccgcaaatcatgttgttatgttccatcagtaacatttatgtgtttctgagaacattacagtgtggcactactatacgtctggccgtcaggaaataaaagtgggtttattcgcgttttataacaataaatagttaattttcagtaaattgtaaccctaaaaatgatttgttccgccaggggttgttcacgaagtaaatggcaaaatgatcctctaatcgcgatcatagtcacaaatgatacggaagtaacatgataatgttattttaatatcattgtcgtgtgacgatttctgagagggagtaaaatggatatcgcggttattggctctaacatggtggaccttatcacctacaccaaccagatgcccaaagaaggggaaactctggaagcgccggcgtttaaaatcggctgcggcggaaaaggggcgaaccaggccgtggcggccgctaagctcaattcaaaagtattgatgttgaccaaagtgggcgacgatatttttgccgacaacaccattcgtaatctcgaatcctgggggatcaatacgacgtatgtagaaaaagtaccgtgtaccagcagcggcgtagcgccgattttcgtcaacgccaactccagcaacagcattctgatcatcaaaggcgctaacaagtttctctcgccggaagatatcgatcgcgcggcggaagatttaaaaaaatgccagcttattgttctgcaactggaagttcagcttgaaacggtttatcacgcaatagaatttggcaagaaacacgggattgaagtgttattaaaccctgcgccagcattacgggaattagatatgtcttatgcctgtaaatgcgatttctttgtacctaatgaaaccgagctggaaatattaaccggtatgccagtggatacctatgaccatattcgcgcagcggcacgttcgctggtagataaagggctgaacaatattattgtcaccatgggcgagaaaggcgcgctgtggatgacgcgtgaccaggaagtccatgttccggcgtttagagtgaacgctgttgataccagcggcgcgggcgatgcctttatcggctgtttcgcgcattactacgtccagagcggggatgtggaagccgccatgaaaaaagccgtcctctttgccgctttcagcgtcaccgggaaaggcacccaatcctcttatccaagcattgagcaatttaatgagtatctttcgttgaacgaataacaatcaccctgcactgttaaaggtagcactatgaacgataaaaacatcgttcagatgcccgacgggtatctgaataagacacctctgttccagtttattttgttatcctgtttattcccgttatggggatgcgcagccgcgttaaatgatattctgattacgcaatttaaaagtgtattttcgctgagcaactttgcttcggcattagtacaaagcgccttttatggcggttattttttaattgctattccggcctcgctggtcattaaaaaaaccagttataaagtggcgatacttatcggcctgacgctatacattgtcggctgtacgctcttttttccggcgtcgcacatggcgacctacaccatgttcctcgcggcgattttcgccattgcgattggcctgagtttcctggaaacggcggcgaatacctacagttcgatgatcgggccgaaagcctacgccacgctgcggctgaatatcagccagaccttttatccgatcggcgcggcggcaggcattttattgggtaagtatctggtcttttccgaaggggaaagcctggaaaaacagatggcgggcatgaatgccgagcaagtccacaacttcaaggtgttgatgctggaaaacactctggaaccctataagtacatgattatggttctggtagtggtgatggtactgttcctgctgacgcgttttccgacctgtaaagttgcgcaaaccgcgagtcataaacgtccctcggcgctggatacgctacgctatctcgccagtaacgcccgcttccgtcgcggtattgtggcgcagttcctgtatgtgggaatgcaggtggcggtctggtcgttcactattcgtctggcgctggagttaggcgatatcaatgagcgcgatgcctcaacctttatggtctacagcttcgcctgcttttttatcggcaagtttatcgccaacattctgatgacgcgcttcaacccggaaaaagtcctgatcctttactctgtgatcggcgcgctgttcctggcctatgtggcgctggcgcccagctttagcgcggtatacgtggcggtgctggtcagtgttctgtttggcccctgctgggcgaccatttatgccggaacgctcgataccgtcgataacgagcataccgaaatggcgggggcggtcatcgtgatggcgattgtcggcgcggcggtggttcccgcgattcagggctacgtggcggacatgttccactcgttacagctctcattcctggtttccatgctgtgctttgtttacgttggcgtttacttctggcgcgaaagcaaagtgcgcggcaacctggctgaagtcgccgcgtcctgaggagatcaaccatgacaacacgtattacattatggcgggagctttttagcgagcagccgcgtatcttgctggaaaatgacgattttacggttacggcgtttcgttacgccagcggcgtggaaggactgaaaatacaaaacagccgcggtcatctggtgattctgccctggatggggcagatgatttgggacgtgcagtttgacggtcatgatctgactatgcgcaacatgttccgccagccgaagccggctgcggaagtggtggcaacgtatggttgctttgctttccattccggactattggcgaatggctgcccgtcgccggaagatacacatccgctgcacggcgagatgccctgcgctgctatggacgacgcctggctggagttagagggcgacagtctgcgcgtgaccgggcgctacgagtatgtgatggggttcggtcatcattatcaggcgcaacctgcggtggtaatgcgtaaatcaagcgcgctgtttgatattcagatgaccgtgactaacctggcttcagtcgccatgccgctacagtacatgtgccacatgaactatgcctatgtgccgaacgccacgttccgccagaatatcccggataccgcgctgaagctacgcgagtcggtgccagcgcatgtcaaacccacggcgcagtggctggcgtttaatcaacgacttttgcagggtgaagcctcgctggcaacgctcaacgagcctggcttttacgacccggaaatcgtgttcttcgccgatgaactggacaagtacacggataccccggaattcagtatgatcgccccggatggcaccacgttcgtgacacgtttcgccagcgcggagctgaattacgtgacccgctggattctttataacggcgatcagcaggttgccgcctttgccctgcccgcgacctgtcggcctgaaggttttctcgcggcgcagcgaaatggaaccttgcttcaactggaaccgcagcaaacccggacgttcaccgtcacgacaggcattgtctgaccgctcaaggcttgaacacccaggcacttatcgttaaggtaagtgcttttgccggatggcggcattaatgccttatccggcctacaacggcacctgcccgtaggcctgataagcgcagcgccatcaggcatgtcttagcgccaggatgaacccatgattaccgttgcccttatcgacgaccaccttatcgtccgctccggctttgcacagctactggggctggaacccgatttgcaggtggtcgccgagtttggttccgggcgcgaagcgttggcaggcttgccggggcgcggcgtacaggtgtgtatctgcgatatctcgatgccggatatttccggactggagctgctaagccaactgccaaaagggatggcgacgatcatgctctcggttcacgatagcccggcgctggtggaacaggcgttgaacgccggcgcgcgcggttttctctctaaacgctgtagtccggatgagctgatcgccgcggtgcatacggtggcgacgggcggctgctatttgacccccgatattgccgtgaaactggcggcgggtcggcaagatccgctgaccaaacgcgagcgtcaggtggaggaaaaactcgcccagggtatggcggtaaaagagattgccgccgagctggggctgtcgccaaaaatggtgcatgtccatcgcgcgaatctgctggaaaaattaggcgtcagcaatgacgttgaactggcgcatcgcatgtttgacggttggtaatgaacacctttttttcccgtttaatcaccgttgttgcctgcttttttatcttctccgccgcgtggttctgcctgtggagcatcagcctgcatctggtagagcgcccggagctggcggcgctactctttcccttcggcctgcgcctgggacttatgctgcaatgcccgcgcggatactggccagtattgctgggcgcggagtggctgctggtgtactggttggcgcaggaagttgcgctggcccatctgccgcttttgatgatcggtggtgtgttgacgctactgcccgtggcgctgacttctcgttaccgccatcagcgcgactggcgcacgttattgcttcagggcgcggccctcaccgccgcggcgctactgcaatccctgccctggctggggcagggggaagcggcatggaacgcgctactgctgaccctcacggggggactgacgctggcccccatctgcctggttttctggcactatctcaccagcactacctggctgccgctgggaccatcgctggtatcgcagccggtaaactggcgcgggcggcatctgatctggtatctgctgctgtttatcgtcagtctgtggctgcaactggggttacctgctgaactttcgcgcttcacgccgttctgcctggcgttgccgattatcgcgctcgcctggcattatggctggcagggcgcgctcattgccacactgatgaacgctatcgcgctgatcgtcagccagacctggcacgatcatcccgtcgatttattactttcgctgttggcgcaaagcctgaccgggctactgcttggcgcgggcattcagcgcctgcgcgagctgaaccagtcgctgcaaaaggagctggcgcgcaaccatcggctggcggagcgtcttctggagaccgaagagagcgtacggcgcgatgttgcgcgtgagctgcacgatgacatcggacagaccatcaccgcgattcgaaccctggcgggcattgtgcaacgactggcggcggataacggcggcgtgaagcagagcgggcaacttatcgagcagctttcgctgggcgtgtatgacgccgtgcgtcgcctgctggggcgcttgcgcccgcgccagctagacgacttaacgctggcgcaggccatccgttcgctgctgcgcgaaatggagctggaaagccgcggtattgtcagtcacctcgactggcgaattgacgaaacggcgctaagtgaaagtcagcgcgtgacgctgtttcgcgtctgtcaggaagggctgaataacatcgtaaaacatgccaatgccagcgcggtgacgctccagggctggcagcaggatgagcggctgatgctggtgattgaggatgacggcagcggcctgccgccgggctctcaccagcagggcttcggcctgaccggaatgcgcgaacgcgtgtcggcgctcggcgggacgctaaccatctcttgtacccacggtacgcgggtgagcgtctcgttgccccagcgttacgtttaaggaaggataatgctttcgtttttaaaagccccggccaacgcgccgctcatcaccgataagcacgaggttgacgcccgctatcgctactggcggcggtatatcctgatcaccatttggttgggttacgcgctgttctatttcacccgtaaaagctttaacgccgccgcgccggaaatccttgccagcggtattctgacccgcagcgatatcggcctgctggcgacgctgttttacatcacctacggggtgtcgaaatttgtctccggcatcgttagcgatcgctctaacgctcgctattttatgggcatcgggctgattgcgaccggcgtagtgaatattctgttcggcttctcgacctcgctgtgggcctttgcgctgctatgggcgctgaacgcctttttccaggggtttggatcgccggtttgcgcccgtttgctgactgcctggtactcgcgtaccgagcgcggcggctggtgggcgttatggaacaccgcgcataatgtcggcggggcgctgatccctctcgttatggccgctgtcgccctgcattatggctggcgcgtcgggatgatggtggccggattgcttgccatcggggtgggcatggtcctctgctggcggctgcgcgaccgtccgcaggcgattggtttaccgccggtaggcgactggcggcacgatgcgctggaggtcgcccaacagcaagagggcgcgggactaagccgcaaagaaatcctcgctaaatatgtgctgtcgaatccctatatctggctgctttcgttgtgttatgtcttagtgtacgtggtgcgcgcggcgatcaacgactggggcaacctgtatatgtccgagacgctgggcgtggatttggtcacggccaacacggcagtatcgatgtttgagttgggtggatttatcggcgcgctggtggcgggttggggctcggacaaactcttcaacggcaaccgcggaccgatgaatttaatcttcgctgccgggattttgctctctgtgggttcgctgtggctgatgccgttcgccagctacgtcatgcaggcggcctgtttcttcaccaccggtttctttgtcttcggcccgcagatgctcattggcatggcggcggcggagtgctcgcataaagaggcggcgggcgcagccaccggctttgtcggcctgttcgcctatctcggcgcgtcgctttccggctggccgttagcgaaagtgctggagatctggcactggaccggtttttttgcggtcatcgccatcgcggcggggatctccgcgctattgctgctgccatttctgaacgcccaggccccacgcgagacccacgaagcgtgatacacctcacctttttgcgctgaatggggcaaaactaagaaattttcccggttttgcctggacgctgtcgcaggccccttttcctgtggatttttacaatgcctgccattcgcaggtataaaaattagctcaggagtaatccatgctggccttcttaaaccaggtgcgcaagccgaccctggatctgccgctcaatgtgcggcgtaaaatgtggttcaagtcgttcatgcagtcctatctggtggtttttatcggctacctgaccatgtacctgatccgcaaaaactttaacatcgcgcagaacgacatgatctctacctacaggttgagcatgaccgagctggggatgattggcctgggcttctcgatcacctacggcgtggggaaaacgctggtttcctactacgctgacggtaaaaataccaagcagtttctaccgtttatgttgatcctctccgctatctgtatgctcggcttcagcgccagcatgggcgcggggtcaaccagtctgtttctgatgatcgctttctatgccctgagcggtttcttccagagtaccggcggatcgtgcagctactcgaccatcaccaaatggactccgcgtcgtaaacgcggcacctttctcggcttctggaatatctcccacaacctcggcggcgcgggcgcggcaggcgtggcgctgttcggcgccaactacctgttcgacggtcacgtcatcggcatgtttatcttcccgtcgattatcgcgctgattgttggctttatcggtctgcgtttcggcagcgactccccggaatcttacggtctgggtaaagctgaagaactgttcggcgaagagatcagcgaagaggataaagagactgaagaaaacgaaatgaccaagtggcagatctttgttgaatatgtgttgaaaaacaaagtgatctggctgctgtgtttctccaatatcttcctgtatgtggtgcgtattggtatcgaccagtggtcaaccgtctacgccttccaggaactgaaactttctaaagaggtggcgattcagggctttaccttgtttgaagtgggcgcgctggtcggcacgttgctgtggggctggctctctgacctggcgaacggtcgtcgcgcgctggtagcctgtgtggcgctggcgttgatcatcgctaccctcggcgtctaccagcacgccagcaaccagtatgtctatctggcctcgctgttcgcgctcggtttcctggtgtttgggccgcagctattaattggtgtggcggctgtcggtttcgtaccgaaaaaagccatcggcgctgcggacggtatcaagggcaccttcgattatcttatcggcgatagctttgctaagctgggtctgggcatgattgccgacggcacccccgtttttggtctgaccggttgggcgggtaccttcgccgcgctggacgctgccgcgatcggctgtatctgcctgatggcgatggtcgccgtgatggaagagcgcaaaatccgccgtgagaaaaaaattcagcaagtcaatatcgcttaaatgtgtgcatttggtaacgttttgcccggcttaacgccgggcttttttatgccttgcgttcgtcagacaggacatccggtgtctggcgtaaatgaagacaggcgttaataaatcacatcctgacaggccagaacgtcgacagttataaatttaccgttatgatgggcatcctgtttggtgacggatgtgcgcatgatttggttgattctggccacgtttgtggtggtgtttattgtgggttttcgggtgctgacatcggatacccgccgggcgattcgccgtctgagcgaacgtctgaatattgatgtagtgccgatagaatcgatgattgatcagatgggtaaaacggcgggcggtgagtttttacagtatctgcatcgccctgatgaatcgcatttgcaaaatgccgctcaggtgttactgatctggcaaatggtgattgtcgatggcggcgatcagaatttgcagcggtggcatcgcttgctgcaaaaagcgcgtttagccgcgccgatcaccgacacacaggtacggctggcgctgggctttttgcgcgaaatggaacccgatatgcaggagatcaacgcgtttcaactgcgctataacgccttttttcagccggaagagggtgtccactggctgcattgatactcttcactatctcgttaacaaaagacgagatgaatgaggctggcaagggcggcgagccacgattaacggccggatggcacgattcatcgttagccaaataaagcgtagccgccatcgtatttgctaagggtgaaccacagaagtaacgcaccgaataaccgctaacgacgccaaaacatcagagacttatagctcatcatttctgtgacatatatcacggaaatgtgatcttgttttgaacaccaaaactgtgactccttgccatacctcctgtctcaaaatttcttatcataaactcgaagttgtacatgattgtctatagacaactctaaatgtttaggcgcgcactatgaaaacattgagtaaaagttcacacatcccactgtatcaacaggttgtggagtggataagggaaagtatttatagcggagaattggttgaggatgaccggataccttcagagtttcaaatcatggatatgctggaggtgagtcgcggtaccgttaaaaaagcggttgaccaacttgtccgggaaggtgttcttgtgcaagtgcagggtaaaggaactttcgtaaagaaggaaaatgttgcttacccactgggtgaaggtttgctctcctttgctgaagccttagccagccagaagataaacttcacaaccagcgtcataacctcccgactggaacccgctaaccgctttgtagcagagaaactgagtatcaaaccgggacaagatgttttatttcttaaacgccttcgttgtattggcgatgaaaaagtcatgttgattgaaaatcgtatcaacattgatctctgccccggtattattgatgtagattttaccagggagaatttattttcagcaatagaaagattatctgataagaaaataagtttttctgaaagccgttacgcagctaaattaattggtaatgagcgaggccattatcttgatattggtgaagacgcacctgttttgcatttggaacagttggtatttttctctagaggattggccattgattttggtaacgtctggttaaaaggtaataaatattatcttggcactattttacagcgcctggatgcctgactagcaaagaggaatctatgcaggatattcattttcgccgtcattatgttcgccacctccctaaagaggtgagtcagaatgacataatcaaggctcttgccagtccgttaattaacgatggtatggttgtatctgattttgccgatcacgtcattacgcgagaacagaattttccaacgggtctaccggttgagcctgtaggtgtcgctattccacatactgatcacaggtatgttcgccaaaacgccattagcgttggaatactggcagaacccgtcaatttcgaagatatgggcggggaaccagatcccgtacctgtcagggtggtgtttatgcttgctttaggtgaaagcaataagcagctcaacgtactgggttggattatggatgtgatctaggatgaggattttatgcagcagttactggtcatgaatgatgatgaaatttatcagtcaatttacacacgcatatctgaaagaggtgaagtatgagtaaaatgatactatttgtttgcgcaacgggtgttgctacttccacggctgtggcagaaaaagtaatggaatattgtaaagacaatgggcttgatgttaattattcccaaactaatgtagcctcattgccaaacaataccgatggtgcagctttggttgtatcaacaacgaaagttccttatgaactggatattccggttgttagtggtctgccaatcattaccggagtaggtgaagataaagttcttgaaaaaatagtttcaatccttaaaggccaagcctgatttcataaataaaaaacagataaattacccaggcgctaacgcgaggtctggtcacatctgaataagaggtcggatatgaatgatatagcacatactctctataccgttgtgcaatatgtcctgggatttggcccaacggttttattgccgctggtcctttttttcctggcattgttcttcaaagtaaaacccgctaaagcacttcgctcatcgttaattgtcggaatagggtttgtcggaatttatgccatctttgacatacttaccagcaacgtaggcccggctgcacaggcaatggttgagcgaactggtattagtcttcctgttgtcgatttaggctggccaccattggccgcaattacctggggctcaccaatcgccccctttgtcattccgctgacgatgctgattaatgtcgccatgctggccctgaataagacacgtactgttgatgtcgacatgtggaactactggcactttgccctggcgggaacgctggtttactacagcacagggagttttgttttgggtctgtccgcagccgctattgccgcgatcgtggttctcaaactggcggactggtcagcgccattagtggcaaagtacttcggtctggaaggtatttcacttccgaccctgtcatctgtcgtcttctttccaattggattgctgttcgacaaaattatcgacaagatcccgggtgttaaccgtattcatattgatccggaaaacgttcagaaaaaaatgggaatcttcggcgagcctatgatggtgggtactattctgggggtcttgttgggcatcattgccgggtatgactttaaacatatcctgttgctggggatcagcattggcggtgtcatgttcattcttccgcgtatggtacgaattttgatggaaggtttattacctctgtctgaagccattaagaaatatttgaatgccaaatatcctggccgtgatgatctctttatcggactggatatcgcggtagcagtaggtaacccagccattatctctacagcactgattctgacacccatctctgtcttcattgcattccttcttcctggcaataaagtcctgccactcggagaccttgcgaacctggcagtcatggcttccatgattgtactggcatgtcgtggcaatattttccgggctgtgataaccgcaattcctgttattatcgccgacttgtggattgcgaccaaaattgcgccatttattaccggtatggctaaagatgtcaatttcaaaatggctgaggggtcaagtggtcaggtatcaagcttccttgatggcggtaaccccttccgtttctggctgcttgaaattttcaacggaaatattattgctatcgggctgattcctgtgcttgcgctggttatttatggtgtttttcgcctgacaaaaggaacggtctatgcctgattaccacgcagcgcttgtcattgacattggtacaactaactgcaaagtcagctgctattcctgtcatgacgtgtcagttctggaagtccgcaagtttccgacgccaacaatatcgtcggacaaaggcgaggtagatttagatatcgaagcgctgtggcaggcactgcgactggtaatggctgaactggtggcttcagtaccgtttccggtaaaaaatatcagtattgcgagtttcggtgagtctggcgtctttgtggataaggagggcgtcattcttaccccgatgctggcctggtatgatcgacgtggtgaatcttatctctcgtcattaagcaaggcagaggctgaagaactgtattctataacgggattgtcacctcacagtaattactcagcatttaaaatgagatggttgcttgataactactccttgcatgaaagaaaagatatctgctggttacatgctccagaagtgttgttgtggcgaatgacaggtgcgaaaaagacggaaatatccctggccagtagaacgttgtgtctggacattgctcgccgtacctggtctcgtaatgctgccgggattctcggcataccgttcggtgtactggctccgttgataaagccgggtgaagtggctggatgggtgacggcaacgctcaggcaggagttgggattaccacatgaggtaaaagttaccctggccggacacgatcatatggtcggtgcccgcgcattacagatgcaaccgggcgatgtgctgaattctaccggcacgacagagggtattttactgctgaatacacagccaacgcttgatgtgcaggctcgcagggataagctggcaaatggttgttactccgatggtgaatttttcacgcttttcgcttctctgcctgtcggcggttatgcgcttgaatgggtgaaaaaaacctttcgtttaactgataaggaaataagcacaggcctggaaaaagtcatggagcaatacctcaaaccttcctggtctgtcgagcatgtgccggtatttattcctcatttgcggggctcgggttcgccacataaaaaccagcacattcgtggcctgctttttggtctgacggattcacttcctccggagtctctgcttgagagtgtctttatcggcctggcgatggagtttgcacactgtcacgggtgctttaatatcccggcaggcaggacagtaaaagtcattggccctgcggtgaaaaacccatactggctccagttgaaggctgacatcctccagtgtccaattgaggccattgcttttgatgaaaccgtctcccttggagcattgttgatagcctgtccgaatgttgtccccccgactgttcctgtggctgagcgatattttcctgacgcggttcgttctgcaaagttgaaaatatatcagcagcaatggctgtcattttaccaatttaaactgcggcaagaaggggcgtttattggtgaataactgtgataactcaatagttcgataatttacttatactgctcacataaatatctggagttaatatgtctttagtcaatggtaggatcctgctcaattgtattcaggaaaaacatgtccttgcgggggcatttaatacaacgaacctggagacaacaatttccattcttaatgcaatagaacgttccggattgcccaattttattcaaattgctcctactaatgcacagctttcaggttacgattacatttatgaaatagtgaagtgacatgccgataaaatggatattcctgtcagcctgcatctggatcatgggaaaactctggaagatgttaagcaggctgtccgggccggatttacctcagtaatgattgatggcgcggcgctaccgttcgaagaaaatattgcatttacccgagaagctgtcgatttctgtaaatcatttggtgttcccgtcgaagcggaattaggcgctattctgggtaaggaagatgatcatgtcagcgaggctgactgcaaaactgaacctgagaaggttcagcgctttgttgaggagacagggtgcgacatgctggcagtgtcaattggtaatgtacatggtcttgaagacatcccacgcattgatatcccgctattacaacgcatcgcgtctgtcagtccggtacctttggttattcatggaggttctggtattgacgcggatattcttcgcagctttgttaattacaaagtagccaaagtgaatattgcgagtgatttgcgcaaagcctttattactactgttggtaaggcttgggtaaataataacaacgaggctaatctggcgcgtgtcatggcgagcgcaaaacaggcagttgaggatgatgtttattctaaaattaagatgatgaataaacatcactcagcactccgcaaagtctcttaaggaaaatatatgattagacaaaaagtacgcgttatgaacagtacggggcttcatgcgcggccagccgctacacttgcgaaaattgtcaaaaaataccagtcttcattaacgctagttaataatgacaaagaaattcccattaaaggaatgatgagtattttgggggctggcgtaaagggaaacacaatgattgatttaatttgtgatggacaggatgaactggcttttatggatgaattaaaatccgcatttgctgatggctttggtgagtcagtatagtgcaattcccgtcaaacggcgcaggaagttgtagaggcttcctgcactcattatcgtatgaatagccttaacagaccatcggtaaaaccctcataccagcacctttagcccgtgtttttggacaacattaagtagtttcagtgacatcccgctgggacgcttggcgccgctttcccacttttgaaccgttgatacgctggtattcaggtaccgagcgaaaaccgactggctaacgttgagttcttctcgtaacgcttttatttcaagtggctgcaggtctttgatgctgcttaagcaggccgtgtcaaaactgcgcattgtctcctggggaatggcatccacgctaaataatccagatgccgcgctatgaatcgcttcaaaggcagggcttttgaatttagtttttgctgacatggcgcacctctaccagttctttgttattaatgagtgccgttatctgatcttcggtcaggcaagcatagtgttttgctaactcacggaaacccgcaagttcgcgatagcgaatgttggccatattctgtttggtatacaggaaggtgtaaaaccaatgttcgcctccctttgccaacacgattgcgcgatcgcggttttaattgagacgtttttataaactccgccgccaagattatctgcttttccttgcagtacggcgttgatggcctcgcttaactcgtcatcttttatcgtgtgggacttcgcttctctgttaaaccacctggttttgaagattcgcatcaggttgacatcctgtaatctaaagtatagcaccaggtgatacactatgtcttaccttttggttttacacgcagcgagagaagataattctcaacgctcgaccagcctcgcaaaatgcagcgcaacaatgtcagttgctaaaacgttaatcagatcacattttgtaatgttacactgcgtggattttccgcactaaaacgacgcaggtaaccacaatgaatgaaaatatcgcagaaaaattccgcgctgatggggttgccaggcctaactggtcagccgtttttgccgtggcgttttgtgtcgcctgcctgattaccgttgagtttttgcccgttagtctgttgacgccgatggcgcaggatctggggatctccgagggcgtcgccggtcagtcggtcaccgttacggcgtttgtcgcgatgttttccagcctgttcattacccagattattcaggcgaccgacaggcgttatatcgttattctgttcgccgttttgctgacggcttcttgtctgatggtctcctttgccaacagctttacgctgctattgctgggccgcgcctgtcttgggttggcgctgggcggattctgggcgatgtcggcgtcgctgaccatgcgactggttcccgcgcgtaccgtgccgaaagcgctgtcggtgatttttggcgcggtctccatcgcgttagtgatcgccgcgccgctgggcagttttttgggcggtattattggctggcgtaatgtctttaacgccgctgcggtgatgggcgtactgtgcgtcatctgggtggtgaaatcactgccgtcgctgccgggcgaaccttctcaccagaaacagaatatgtttagcctgttgcaacgccctggcgtgatggccgggatgatcgccatctttatgtcttttgccgggcagttcgctttctttacctatattcgcccggtctatatgaatctggcgggctttgacgttgatggtctgacgctggtgctgctaagttttggtattgccagcttcgttggcacttctttctcctcttacgtcctgaaacgttcggtaaaactggcgctggccggtgcgccgctgctactggcgctgagcgcgctgacgctcattgtgtggggaagcgacaaaaccgtggcggcggcaatagcgattatctggggactggcgtttgcgttggtgccggtgggatggtcaacgtggatcactcgttctcttgccgatcaggcggaaaaagccggttccatccaggtcgcggtgattcaactggcaaatacctgtggcgcggcggtgggcggttatgcgctcgacaatttcgggctgctttcgccgctggcgctttccggcggtctgatgctgttgacggcgttagtcgtggcggcgaaagtccgtattacgccaatgagttgatattgctgccatttgtaggccggatacgacgttagtcgttatccggcaataataaacgcttaatcaaaaccgttatgctctgcggtggcggcaaaccattctccgctttttttcaccgtgcgcgtttgggtggctaaatccagttgtacaaaaccatagcgatttttatagccgttcagccatgaccagttatcgataaaggtccacatgtggtagccaagacagtgacagccctcgctaatgcctttatgcagccatttaagatgctcagagataaagtcaatccggtaatcatcgtgaatctgtcccgcttgcacaaaacgctgctcgttctcaacgcccatcccgttttcggagataaaacagcgcggattgccgtaattatcccgcaggttggtgatgatgtcgtaaattcctggcgcgtaaatttcccagccgcggtaagggttcatcttgcgccccggcatgtcgtaatagtcaaataaccactccggcataaacggcgcttgcggattcaccgctgtatcacggcatttcacgcggcgcggctgataatagttaatccccagtaaatcgattttgccgtcggcaataagctgacggtcgcctggctgacaggcaggcagctggtcataggttttcagcagcgccaccagctccgccgggtattctccctttaataccgggtcaagaaaactgcggttgaataacagatccgcatgatgcgcggcttgcacatcggcgggatgctgcgagcgtgggtaggacggcgtcagattcagcactacgccgatttcaccgtcgtagcgcccggcgcgccaggcgcgcacggcggtcgagtgcgccagcacggtatggtacgccacggtggccgcacgtttaaaatccaccacattgggatagtggaagtcgtacaaatagccgccttccaccggcacaatcggctcgttaaaggtaaaccagtgcttcacgcggtcgccaaacaaggtaaaacacgtttgcgcgtaccgaccaaacgcctctacgacgtcgcgattttcccagccgcctttctcctgcatgaccatcggcatatcaaaatggaacagcgtaataaacggcgtgatgccctgcgccagtagctcgtcgatgacgtgattgtagaagctcaccgcttgtggattcacctcgcctacaccgtctggaatgagccgcgcccagcttagcgaggtgcgaaaactgttgtgttttaactgtttcagtagcgcgatgtcttgcttccagtggcgatagaacgttgaggtttccgctggaccgatgccctgatgaaaacgatcaggctggcgctcgaaccacacatcccacgtggtctggcttttaccaccattcagactatccccttcggtttgcaacgctgagcaggcgctgccccaccagaagttatcgggaaaacggtatcgcattgtcgtactccttgatcgcgtaaattcgctccagaatatgcgcttttggcgaacagaaaccggttacagtccgcattttcgcgaccaaaaagcggaaaagctgtgctacatctccgggcattccaccttgccgagagcctgccagtagttatgctgattgttgcgctctatcgcgatcatcgcctcccgaatatgctgctggttcccctcgcttgccatgatttttttctcccaggcttcatcggttagcgcgcctttgggcgtacacattttgcgcaaatcctttaaaatcgtatttttttcatgcgccgactggagtgagctaaacggagagtcggcatacgtgacgcccggtagcgcgacaagtgtggcaataagcagaagcgtttttcgtttcataaacggtatccttatcggtttgcactttttcaagagtaagtgtagaccgtgcgacgttcactcatcggggcgtgctatccgttggcgttgaagtcaggcaaaagtgggaaggcggtttctcgctgcgccttcactttcttgcgtggcagaatagtgtatgttctgactactcttttatttcgtaagcggtagtgtaatgagacgtattgagatcgtactgggagagctggaacggctgacgcgcgggctatgccttgccgatttggcgcaggagacggcgtttacggcggaggcgataggtttcaatcttgggctggcgcgtaactccgtcagcaaagatctcaatcagttatggaatgacggcctggcaatcaaaagccgtggccgcccggtctattttttggcatcgccaggcgctggaaacgttgctgggacgtcagctggaagagtctgaacgcgaggtgcggtcggtggcggatgtgctgccgcatgaagagcattacgcgcccgacgatccgtttaccagcctgattggttacgatcgcagcctgcgcgatgcggtagaaaaaggccgtgcggcggtgctctatccgcacggtttacacgttctgcttaccgggccgtccggcgtcggtaaaaccttttttgcggaactgatgcaccgtttcgcctgtgaacaggcgagcggcgctatcccgccgctggtctactttaactgcgcggaatacgcccataacccggaactgctctcctcgcatctgtttggtcatcggcagggggcgtttaccggcgcgaatgaacataaaacaggcctcgtggagcaggcggacggtggttatctgttgctggacgaggtgcaccgtctgtcttatgaagggcaggaaaagctgttttctattctggataaaggcgagtaccgtccgctcggcgtgagcagccagccgcgatcaatttcggtacgcctgatttgcgccactaccgaaccggtcgggtcggcgctgttacgtactttccagcggcgtattcaggtatgcattgatttgccgggcattcgccagcgctccgttgaagaacagatcgaactgatcgtggggttcttacagcgggaaagccgcaaaatagaacgcacggtcagcattgataaaccgttgttgctctggttgctgaataaacccctggaaggcaatatcggtcagctaaaaagcgatattcagtttctttgcgctcaggcgtgggcatcgggaatgaccgagcataacgacacgctacagctggataaacggctggcggagatgtcggttaacccgacgccggaacagcgtctattggtggatactctgtttgacggtaaagcgcggctaaatatagacgcgcgcacgctgcccgcattgaagacgtcgctggcgaccggggcggaaattgaagagagcgacctcttttacagcttcctgacgcgcgagtatgttaatttgcgcaacagtaacgtccccccggcggagacgctggcgatcctgaaaaataaactcagctcgatttttgaatacggtctctatagccgcgacagcgtggcgcatccgccgcgctatggcgaccagattgaagagcgcgtgacgctgctgattggctgcgtagagcaggtgttgggcttttcgctgccggaaaatctggttaacccactgcgtaaacacttcctggcgctgataggctacgtgcagcgcggcctgatcccgcagctttactcttccagtttgatcctggatcgctgcaaagacgaatatgacaacgccacgctgctgtgtcggaaaatcaacgaactgctgcatatacagtgtccggcgacggaagtggtctggctatgcctgttcctgaaagagtgccgccattatcgtcagcgtatcgatgccagccccgactgcggggtcattttgatcgctcacggcgcgaccaccgccaccagtcaggcgcaatatgtcaaccgcgtgctggagcgcgagctgttcagcgccatcgacatgccgtttgaacagtcggtgcatgacacgctggaaacgctgacccaaatgattcaaacccgccaatatcggcggcttatcctgttggtgggcatcggttcattgatccatttcggcagcaccatcagtaaattattccagatagatgttttgctcatgccgaatatcacgctgaccagtctactggaagtcgggctggatttaagctatgaaaccagcgacttaccacagttgacggcgctcctgcagagtaaaaatatcccctgccagctttgtacgccgcagcaggagaacggcggcaaagtgctggtcatctcctgtattaccggcatgggaacggcggaaaaaatcaaaaaggtgctggaggagagctttggcgaactgatgtcgcaggacaccaggatggtgatccttgattataacgaggtacgaagtctggagcgcgttcagcaggcattgaatgccagcgagcggctggcggggattgtcggcactttccagccggggctgccggatattccgtttatttcgctggaagagcttttctccgaacaagggccggaactggtgttgagcctgttaacgcccgatctgtccaacgctgaacgccgtctggagatggagcgcagcgcgatgcgctttatcagcgcgctaacgatggagagcatcatcaaccatatttctgtgcttaacccgcagcgtattctgaaagagatggagggcgtttttaaccatctgacgtcttcgctttccctgaaaccaagccgccaggtgacactgcgcttcctgatccactgctgctgtatggtagagcgtattgtgattaaccgaaaaccgttacagatggcgctggaacgtcagccgaatctggacgcgcgcgcgtttagtgtcatcaaatccgcttttctgccgatcgaagacgcgtacgccatccgtttatcggatgcggaatatttttatatctacgaactgctctatagctaatccttttactggcggggcttcgcgcctcgccagacctttcttcttcctcgcgtgacacaaattctggcacaacctttgctcttctgatgatgcgttatgccggatagcagcgtaaacgccttatccggcctaccgggagtgtcctgtcggtccggtaagcgcagtgccaccgggcaatatatgccggtgttctcatgtaattgcgccaggaggccattattttgactaccacacaaccgttgccccacatcctgctgctgacgcatggcggctggggacaaccgctttgcaacagcctgcgtatggtcacgggcgaaattaaaggcgtgacggaaatcgcgctaatgcctgtcgatacgctgggcgagttttatcaacgcgtcgaggccgtggtgaaaacgctgccggaaggctcgctgatcctgacggattttgtcggcggcacgacgtccaacgtcgcggcgcggctaagcgccgattatccggtggcggtgattgccggattgaatgcgtcgctactgctggaggcgctggacaggcgcgaacaagggatgctaaccgcctgcgtggatgagttagttgaggccgggcgcagtagctgcctggatgtggtcgcccatgtacgtcagctacaacaatcactctaaggaaaacatcatggccaatatcgttttatgccgcatcgacagccgtctcattcatggacaggttgtcacgaagtgggtcggacaatctcaggcgaaccggatagccgttgtgagtgatgaactggacgccgatccgtttatgaaaaatatctacctgatggcggcgccgccaaatatcaaagtggattgcttcggcaaccagagttttgccgctgcatggaaagaaaatcagcttggcgacggtaacgtgctggtgctttttccctcactggcggcggtgcaggacgccatacaattgggctttgacgtcacccgcattcaggttggcggtctcggcggcgggccaaaccgcaaggcggtttttcagaatattacgctggatgaaaaagacgtcggcattcttaacgacctgaaaaaccgtggcgttcaggtatttttccagaccattccggaagataagccgcagccgctcgacgatatcctgaaaaaattctaaccctttaatagacacaaaatcattctggatgcatcgaggcggcaactgagtgaatcccctggagcttactaaagtaagtgactggggtgagcgaaggcagccaacaaagaggcagcctgaaggatgaagtgtataggataacactatggataccttactctttgcaagcctgatggggttgtattactggtttgcccgtttacgcctcggctacaccttctccgcgatgctgttacaaccggtggtgatcgcggtatttgtcgggcttttgcttggcaatatgcagaccgcgatgatcatcggcgcagggatgcagctcgtttatttgggcgtgacctcaacgccgggcggcaacgtaccgtcggacccggcgctggcggcctgtatctccattcctatcgcggtgaaggccggtatggacccaaacctggcgatcgcgctggcaatcccgtttggcgtgattggcgtgtttctcgatcagctgaggcgcacgctgaacgccgcctgggtgcatatggcggataaacacgcggaaacggcaaacatggcgggcatcatgcgttgcgcctttctttacccggcattgctggggctggtgctgcgcttcccggtggtctttgccgctaactactttggccaggatgtggtggaaagtttccttaaactgatgccgcactggttaacccactcctttgaaatcatgggcggcattctgccggcgctgggctttgccatcaccattatggtgatcggtaaaaagagcctgttgccgtggtttatcggcgggttcttcgcggtgttatacctcaaggtcgacatcatggcgatggccatcttcggcacctgtgtcgccttcttgattaaaggcctggcgaaaaatgaaggagcagcatgatgagcagtgacgtaatgcaacatgaactggttgagcgcgcgcgggaaagcggggcgctgaccaaagcagatatcaccaaagcctggtttatctactggctgggcgccgaggtttccagctcctatgagcgcttacaaagcctgattttctgcgcctcgatgacgccgatcatcaaaaaactttacccacaaaaagaggagcaggtagaagcgctaaaacgccaccttaacttctttaactccgagcagaccttcggcgcggtgattcagggcatctctattgccatggaagaacaaaaaacgcgcggcgagccgattaacgactcgtctatcaccggcattaaaacgggcctgatggggccgcttgccgggatgggcgactcgattatctgggcggcggtgatgccgctgttgatagcgatctttattccgttcgcggcaaatggcagcgcgatgggcggtattatcccgctgattctctacccggcgatcaccctggcgatcagctacggtatggtccacaagggatatacactggggcgtgattcgattatcggcctgctgcaaggggggcgaatcaaagaactgatctacggggccaacgtgctgggtttgatcatgatgggcgcgctttccgccagctacgtcaaaatcaccacgccgttaaaaattagcgccttgaaaggatctgaagtggtggttcagcagatcctcgactctatcgcgccgggcttactgccactggcggcggtattcgccatctacttctatctggtaaaaaaagggccgcgctacaccaccattttgctgtcgattgtcgcactgagcatagtctgttcgttgttgggagtgctgtaaatcatgacgccgaatatctatcaacaactggggttgaaaaaggtcattaacgcctgcggcaaaatgaccattctgggcgtctcaagcgtcgcgccggaggtcatgcaggccaccgcgcgcgcggcttccgctttcgtcgagattgatgcgctggtggaaaaaaccgacgaactgatatctcgctatacgggtgctgaagatagctatatcacctcgtgcgcctcggcgggtattgccattgccgtcgctgccgctatcacccacggcgatcgggcgcgcgtcgccctgatgccggacagtaccggtatggccaatgaggtagtgatgctgcgcgggcataatgtggactacggcgcgccagtcaccaacgccattcgtcttggcggcgggcgcatagtggaagtggggtcgagcaatctggcggcccgctggcaactggaaagcgccattaacgaaaagaccgccgcgctactgtatgtgaaatcacaccattgcgtacagaaaggcatgttgagcattgacgattttgtacaggtggcgcaggccaaccacctgccgttgattgtcgatgccgcggcggaagaggatttgcgcggctgggtggtgagcggcgcggatatggttatctacagcggcgcgaaagcctttaatgcgccaacctccgggtttatcactggtaagaaaacgtggattgccgcctgcaaagcgcagcaccaggggattgccagggcaatgaaaatcggcaaggaaaacatggttgggctggtgtatgcgctggagaattaccaccagggccagacgaccgtgaccgcagcacagttacagccggtcgcggaagcgatttctgccatccatgggctttatgccgatatcgaacaggatgaggccgggcgtgcaatctggcgtattcgtgtgcgggtgaacgcatcagaattggggctgaacgcgcaggacgtcgaagcgcagttgcgcggcggcgagatagcgatttacgcccgcaaatatcagcttcatcagggggtttttagcctcgatccacgcacggtagctgaaggggaaatggcattgattgtggcgcgactcagggagattgcagaacatgcagcagattaatttttatcgtcagcgggtagcgattaacgtgctggcaaaggatatcgccaacgcgaaggctatctatgaagccgccgaaggccatgcggtcattggtgtactttccgcgcagttcgctacggtagaagagggcgtgccggaggtgaaacgctggatggcggaggtgccgtctatctcggtggggctgggcgcaggcgacccggcgcagtactacaaagcggcgatgattgccgcccatactcacccggcccatgtcaaccagacctttaccggcagcggcttcgcagcgggcgcactggcggcgacaggcggtgagcaaacacatattaacgccctggtcagcccgacgggaacgcctggcgaggtggtgatttctaccggcgtcagcagcagccagggaatgccagcccgcgtttcctgtgaagcggcggtacgcatgatgcaggatatgggcgcacatgcggcgaagtttttcccgatgggcggcgaaaagtcgttaccggaactctatgcgctggcgacaaccgccgcccgccacggcatgacgctcatcgagccgaccggcggtatctcactggataatttcggtattatcctgcaaacctgcctggaggcaggcgtgccgcgcgtcatgccgcatgtttacagctcgattatcgatccgcaaaccggcaatacgcgccccgaagacatcattcagttgatggagatagtcaaagcgctggtgtgagatttatcgccgaagagcgctacgtttacctggcctacagatgacgtgtatttgtaggcccggttagcgttacgctaccgggcgataatgcgtagcaggctgagcaaaaatgtacgtattgcagccgtcagtgattccctttcgagcctcctcgcagggttaaattttcctgaatgctgtctgtatttttggcgagtacagtggcgtcatcttattcctcaggtgacggatcgccatgaaaaaaagccccacgtccacgcctcatgatgcggtattcaaaacgtttttacgccatccggataccgcgcgggattttctcaatattcatcttccccatttgctaagaatacgttgcgatctgacgacgttgaaactggcgccggacagttttatcgagaaaaatttacgcgcgttttattccgacgtcctttggtcgctaaaaacgtgtgaaggtgacggttatatctatgtcgttatcgagcatcagagtacgccggacgcgcatatggcgttccggttaatgtgttacgcgactgccgcgatgcagcgccatctggatgctggccataaaacgttaccgctggtgattcccatgctgttttaccatggcgcgaaaagcccgtatcccttttcgctttgctggctggatgagtttggcgatcctgcactggcgcgtcagctttatgcgacggcatttccactggtagacattacggtggtgccggataacgagattatgcagcatcgacgtatcgcgatgctggaactggtacaaaagcatatacgtcagcgcgacctgatgggattggtcgagcgtttagcggtacttctgattatgggaaacgctaatgacagtcagctaaaagcgctgtttaattatttgctaatacagcatggcagcacgcctcgttttggcaagtttatccgcgaggtggcgcgttgtgttccccaacacaaggagagattaatgacgatcgtagacagaatacgtgaatcggggcgcagaaaaggtaagcgtgaaggcgtgcaacaaggcatacagcaaggtatacatcaaggtaagcaggaggaagccttgcgtattgcgcatacgatgctggaacaggggatcgagcgagagatggtgctgatgattaccgggctttctgacgaagagattaaggcaaagcgccattaaacttttccctcttccgcccggtcatcgtgattatcaacggcgttaagcggcccgcgcgcgtcgacgggaatcgagggagatcagaatcactgacgagagaatgagcagcgtgcccagccagtccggcaaggtaaaactaatccccaacagcagcagcgacagcagggcgctgcttaacggttccgcgcagcttaaaatgctggctttggggccaccaatcagctgcgcgcctttcaaatacaggctgaacgtcagcgacgtaccgatcaccaccaggtagaaaaaggccagaatcaggctgccgctcaccgcaaagtgcgttccttctttagcgtagaagggcagcagaataaggccgccaaaggacatactccagccgaccactggcagcgtgccgtattgggcgattagcctggaaggccaggtcgtataaaaggcggcggcaaatgcggaggcgataccccagaacagcgcgcctgaagagatcgacagcgatgttggattgccgtgagtcaccagtaaaaaggtgccgataagcgatgtaagaatggcggttaagaccagaatgcctggtcgtgttcttcgcgctaatgcaaaccacgcgacaataatggtcggcgataaaaattgcagcactgtcgcggtggcggcattggatttttcaatcgtgagcaggaaggttagctgaacggtgagcgcgcccaccacggagaaaatcagcagactcagtgcatctttgcggtttttaagaatcgaaaatatcttatcgccgtgcataaaggagaaggtcaccagtatcagcccggcgaataacaaacgtatcatcgtcaggaactgtgacgacatacggctttgctccatgatgtactgcgcgcaaacgcctgaactcccccacaatacggcggcaatcaggacgtttagcatcccttttctggtggaacccattttttcctcgtcatgttgttttatttttttacgtgcaggcatcataacagagctatcgccggcattaagcaggaatttattgtttaatgatttcagacgagcctgttattgacataatattgtcatttttttgtcacgggaaatatcaaacaaacttaaacaaatcgtcactatccccgcctttgcactttacagaacatattgactgactataataagcgcaaattcatgcaggagtaatatgttggacagtcacttttacgtaaatcatctggcaagttaacgcacgctattcctgcgctgcttgccgaaccggtgggcagcaatctccccttgtgacgattgtcatcccaataatgttacaacacgcgcattgtcgcgaggtaatcgtcatgttcatgtttaaacacgctttatttcctccgccgttaacacgacgctaattgcctcagggcagaaatttgtcgtgtgctaaatatagcacgtacttattcttccagaaaaaatggaggaacgtatgttaatgtttccttatattttaaatttactggccgctatgctgttgggcgcgctgattggcgcggaaagacaatggcgtcaacgtatggcgggattacgcactaatgcgctggtggcgacaggcgccgccgtttttattctgagctccatgacgacatcgccagacagccccgggagaattgcggcgcagattgtctctggtattggctttctgggggcgggcgtcatcatgcgcgaagggatgaatgtgcgcggactgaacactgcggcaacgctatggtgttcggcgggcatcggcgtgttatgcggcttagggcagttcaaaaatgcactggcggcgacgatcattattctttgtgccaatattttattgcgtgaagcggcgcagcgtataaatcaactcccggtatccgccgaggcagaaaaacgttatatcctgaaagtaacctgtaataaagaagatgagagcgcggttcgtcagtggttactgaatatcgtaaaagaggccgcgatctgtttacaagggttaggttcggtccccgctcaggaacagggctataaagaaattcgtgccgagctcgtgggtcatgctgattatcgtaaaacgcgagaactgattatatccagaataggtgataacgataatatcaccgcaattcactggagcattgatagtcaataatagttttttattcaattgcaacattacgccaggcgtataaggagggaatgatggatattcccgagtcgataaaataaaacccactcaaaatagtgagtaagcaataaccttttttatgcatagataattctcccggggcattcaccttcaaatcgtgagtttactattccctgggcgtgatatgcaggaaacactacaccttaattttggggattcatcatgactgacatgaacattgaaaaccggaaactcaatcgcccggcgtcagaaaatgataagcagcataaaaaagtatttccgatcgaagcggaagcttttcatagcccggaggagacactggcgcggctgaacagccatcgtcagggcctcacgatagaagaggccggcgaacggttgaaagtgtatgggcgcaatgaagtggcgcatgagcaagttcctccggtgctggttcagcttctgcaggcattcaataacccgtttatttacgttctgatggcactggcaggggtcagtttcatcacggattactggctcccgttacgccgtggcgaagagaccgatctcaccggcgtgctgattattctgacgatggtcagtttgagcgggttattgcgtttctggcaggagtttcgcactaacagagcagcacaggcgctgaaaaagatggtgcgcaccaccgccacgatgttgcgtcgtgggccgggcaatataggcgcggtgcaggaagagattcccattgaagaactggtgccgggcgatgtggtttttctggccgcaggcgatctggtgcccgccgacgtccgtctgctggcgtcgcgcgatctctttatcagccagttaattcttagtggtgaatcattacccgtagaaaaatacgatgttatggctgatgtggcaggtaaagacagcgagcaattgcctgacaaagataagagcctgttagatttgggcaatatctgtctgatgggaaccaatgtaaccagcggcagagcgcaagcggtcgtggtcgcgacgggaagccgtacctggttcggctcgctggcgaaatccattgtgggtacgcgtacccagacggctttcgatcgcggagtcaacagcgtgagctggctgttgatacgctttatgctgatcatggtgccggttgtcctgctgatcaatggtttcagtaagggagactgggtagaggcttcgctgttcgcgctggcggttgcggttgggttgacgccggaaatgttgcccatgatagtcagttccaacctggcaaaaggcgcgattgcgatgtcgcggcgcaaagtgatcgtcaagcgcctgaacgctattcaaaacttcggcgcgatggatgtgctgtgtacagataaaaccggcaccttaacccaggacaatatttttctggagcatcatctggatgtgagcggtgtaaaaagcagccgggtattgatgctggcctggctgaatagtagcagccagagcggcgcccggaatgtgatggatcgcgccatactgcgttttggcgaggggcgaatcgcaccatcgacaaaagcgcgcttcattaaacgcgatgaactgccattcgactttgtacgtcgccgggtatcggtcctggtggaggatgcgcagcatggagacagatgtctgatctgtaaaggcgccgttgaagagatgatgatggtagccacccatcttcgcgaaggcgatcgtgtggtggcgctgacggaaacacgccgcgagctgctgctggcgaaaaccgaagattacaatgctcagggattccgtgtattgctgatagcgacacgtaagctggatggttccgggaacaatccgacattaagtgtggaggatgagaccgaacttaccatcgaagggatgctcacttttctcgatccgccgaaagagagcgccggaaaagctattgccgcgttgcgggataacggcgtggcggtcaaagtcctcaccggcgataatccggtcgtgacggcgcgtatctgtctggaagtgggtattgatacgcacgatatcctgatcggaacccaggttgaggcgatgtcggatgccgaactggcgtctgaagtggagaaacgcgcagtattcgcccggctgacgccgttacaaaaaacgcgtattttgcaagcgctacagaaaaatggtcataccgttggttttcttggagatgggatcaacgacgcgcccgcgcttcgtgatgcggatgtgggaatttccgtcgatagcgccgccgatattgctaaagagtcatcagatattattctgctggaaaaagatctcatggtgcttgaggaaggcgttatcaaagggcgggaaacctttggcaatatcattaaatatctgaatatgaccgccagctctaatttcggcaatgttttttcggtactggtagccagcgcgtttattccgtttctgccgatgctggcgattcatctgttgatccagaatttgatgtacgatatttcgcagttgtcgttgccgtgggacaaaatggataaagagttcctgcgtaagccgcggaaatgggacgcgaaaaatattggtcgttttatgctatggattggcccaacgtcttctattttcgatatcacaacctttgcgctgatgtggtacgtttttgcggctaataacgtagaggcgcaggcgctctttcagtccggctggtttattgaggggctgctctcgcagacactggtcgtgcatatgctaaggacgcagaaaataccgtttatccaaagtcgggcgacgttgccggtattattgacgaccggcttgattatggcgataggcatttatattccattctcacctctgggcgcgatggttggactggagccgctgccgctgagctacttcccgtggttggtggcgacattattgagctactgtctggtggcgcaaggcatgaaacgcttttatatcaaacgctttggccagtggttttaataatgtttgaggatcgcccagatgaatcgctcacccgataaaatcatcgcgctgatatttttactgattagcctgttggtgttgtgtttagccctctggcaaatcgttttctaacgaggtgacgccatgcaaaaaagagggttggacaaaattttttatcaggttgtcctgatagcaatcatcctgattttactgactatctggatacgataagctgccgttggcgagccccgcttaaaataagaatcgatgtagttgttctttttatggcggggcgctattttcatggtatcccacatgagaagggcaatatcatgaataatcgtcgtggtttaaccgccgtcctggcgacgttgattacgttttccctgagcgctacgcctgtgctggcgaatccgggaaatggcaatggcggcggacatggtaataacgcggctaatcagggtaataacggtaacggacataaaggaaatgccgggcaaaaaacggaacaccgtaaaaatggcggtaaaccggatcacgtcgagtcggacattagctacgctgtcgccaggcaactggcagtgaatttagggctgacgggttatcagtctttacctccggggattgcgaaaaatctggcgagaggaaaaccgctgccgccgggaatcgctaaaaaacggtgccggcgtctatgctgggacaattaccttattatccgggctatgagtggaaaatcgttggggataatctggtgctgatcgcgctcagtaccgcggtggtcacggcgattattaatggcgtatttgattaagagcctatcccaccaggcgttattggcgcagccagtttggacacggacagcgcgcaaaaaccggagcgtacacgtagtatgtgaggtttgactcgctacgctcgcccttcgggccgccgcaagcggcgttcaaaacgctaacgcgttttggcgagcactgcccaggtccaaaatggcaagtaaaatagccccaatgggataggctctaagcgtgttgtagtccgatgacatggcgctcatctactggttgtaggctgaataaacaggcgatagataaaatagccccattaaatggggctatttagccgcttcagggcgttatttatgcgcgttgagaatccagcagttcattattttttactacttcctgcgctttggtataactttcaatcagtagctgataggccgggaatattttggtatatacatccgcccattctgcggcatcttcccgattccaggtacgttgcagctcagaggctaccgccgcggtatccattggtactacgcccgcctgcaccacgcgggccatcgtaatttcctgcgccattttactgtacgtaccggaggcatcaattaccgcaaataccttgtacccttccgcgacggcgctgatggctggaaaagccatgcagacactggtaatagtaccggcgatgatcagcgttttacggcctgtcgcttttaccgcctgtacaaaatcggcattatcccaggcattaatttcccctttacgcgcgacatattgcgcgtggggcgcattcgcatggatttccggaatcagcggaccatttggtccctgtggtacggatgcggtagtaatgaccggcatattgcataaggtagcgattttagccagcgccgcggcgcgcgcgcgtaattccggcatcggcatgtcgccgacggtctgaaacaggccactttggtggtcaatcagcagcatgactgcgtcgttagcatcaatggcagggcgttgaccgttaaaattcgcgggtgtagacataattcattccttgttgttgcctttcactgatagtcactatcagtgttaaagtcattaatcgccggggcgatttccgtttttaagctgatgacagtaatccgttgccgattctggattaccctgttgagttctttctgaaggaatattcatcggcatcaccttcagtcaatttactttcacgcgaatcggttatcacaacaatattcatattatgattaaatgtttctattttacatgtcagagaggattattgattgaaaaaacaggctatatccctacaaattgtttctgatggatagttttaaaattatttagtataagtttgaaatatatcaattaagagttaacttatttatatttaaataacataaagcacagcttaaatattaagtgggaagcgtgttgttattaagtatggctactgcaactcttaataaattggaaactatccctacataacgagtgctgcttttttggatattacaagccattatagagaacacgttcaataaaaccctgtctttcatatgatatagattttcaggatatattttctcatgatttatatatgagatattaaagcgtagtggcacagtaaatttggctacttgattaaaggtgatattctcacctcaatacaaaacaggaggcttaacgaacaagaaaaccaaacgtactttcacccctgagtctgctataatgagaaaagcggtgtctacgcttacctgttaatgtcttatgcctctcgctcttctatatgatcggtatgtgcaggggacaatccatgtcctgctacgcagccacagcatcagactatactcagtggtgtctattaaccctctccaactacgttatgttttggcatggtaacaatgcgatgttatggataattaacgataatattgaatttaatccagaaatgaatcgcctggcgtcattatcgaggccagatctcaacattattctgacaacgcccgccagccgctgcttgcgccttctgctggaaaacgccccctccgtcgtctcacaacaaacattctttcaaaaagtataggaagaagacggcatggtggtgtcggcaaatacgctttatcagaatatctccattattcgccgcggattacgtaccgttggcgaaaatgaagatacgctgataatcacggttccgcgtagaggctttcagattgagcctggtgtgagcctcatgaccatccgcaaagacttcgctcagacaatagaaaaaagggtgaggcgccaccgcgtatgtcagggcgttggtttaaacattatgtacctgtactttggatgaccgggacatttgctgtcggtattttgcttggcactatcagctggcaaaccgttcctgataaggatttttatgatcgctacacgctggttgaaacaactcagggctgtcattttttctcgcggaatgaagatatcgaaagcggtagccgctttgcaggctataagttaatgattctaaaaaccggtatggattgtcagaaatacccatgggtctatttcccttccagcagtcgcaccccagcggttacggcattgatttgtcagcaaccttataaaacgcgcggtgatacaggctgcgtgacgctttttttccgcggggtgacacatgggtaaaaaggcactgatgttagcctgcctgacgctactgtttctgggtgtagggcttgggcatctttttcatttatatacggaaaagaaccgggatccagagaaatgtacggcgcctgtgattgtgttttataacaacactcaggctaacctgacgctggactttatgtattcgctgaaaaaacgcactggagtggtttccatcagcggaacgtattacgtcgataataaaatgagcggcgtgatccgccgtgatgtttcctatgtatggagtgaaaataaagacagcacccattttatatcgacggatatcaacaaagtcacgcgtgacgaaacactgtccgatgcggttatcgagacggttttacccgatttttatgtctatccagggaaaagtatcagttacaccatcctgactcagggtcatcgtggctttatgttcaccatcgggaaacgcccgatatttttctgtacacattaagcggttttgggagccgttcatggaacgtatcagccaaatgaaagcgcttccgggtaaaagccgctgaagatcagcggctctgttgttacctgaatcagaaactgtatttaacccccagtaggccttgggtattactatagccctggtcacctacctgttgcgccacgttaccccatacgttcaggcgcggggtaatttgtccttcaatacccactttcagttcaccaatatttttcgtaccacgcatatcgctgctgacatcgtccatcttcacgctggcaggctgcgtattatggatccagttcgcttccacgaatggctggaactctcgagatttattgtcatcaatagcattgtggccgttaatataggcttttacgcccatgcgggttagcagattaccggcggtatcatccttgacgagggtaccattggcttcgcgatggtcgttagcctgcacgcccatccataccacctgcgctttgggctgcaaccagtagctttgatgcgcgctttcacctaacctgaaactgtaaccggcttcaaccgaggcggtaattcctttggatttatatttctcagcggcctgatcctgacccatgaccttgttatcaaaccagttgtacagcatccaggtatccacataagccccagaccgatcgatattgttagcataccaggtgccgtaaaggccgacgctgtaaccggtgacttgaccacgggaatgatagtcactcacggacgactgcgtgcggttctggctgttggcataacctgccattgcaccaatatgccaacggtcaagactgtcagtgctccactgtgccagatcgcctcccagttgtaacacatagctgttgatgcgggtttttagctgcccgctgccatcgttgaagcgagtatgggcgccgacgttacgcatccacaggctggtgaccttcttctcacccgtcagcatgtcggtgtactgggtttcacccagacggtcatggagacgcgtcatgaacagcgtatttgccgcatagttgttggcaagatagctgcccacttccggacggaactgatgttctgttatcggcggtgtgtcagattgtcctatgtcaggaatgaccggatcagggatgaccgggtctactggatcagggtctactggatcagggtccaccggatcgggaataacagggtcagggataaccgggtctactggatcagggtctaccggatcgggaatgacagggtcaggaataacagggtctaccggatcaggaataatcggttcgtccggctcaatgtagctggtcagataccagtttttacctttctgcaccacgttgtagtcataggctccggcaacaatacgacttgctttttcgaaagtaccgttggaattgccagcaacgttaacaatttcaataccttcaacggtttgagccccggctcctccaatattatttactgcaacaaatgtgttgcctgaagtattgccgagaacctgcagcctgtccgtttcggaatcatcatcgttgagcacagtattaaagaccagcttaccgccgttgcctacataatcttcattgatggtgagcgtttgccatggttcgccatcttcatggctgaagttaatgattgcgccactattcagcgtcaggtcagtgagcgttgagctgctggtcatattccaggtcgcatcgctcatttgtacagagataacgcctgtgcccgccgtagcgctggtgatgtacgacgccccgtcccatcgcgagttgtccgtcatattgagcttaatcgtactgttctgctgcggtagcgtaccgctggcagcggtggcgccagcagcacgaatatcaccgtcgatgacgaaacgacctcctgaagaaccgtcaacaatgccgccagtttccgtgctgatggcgtaactttcgctactgttatcgcccgccatagtaatagccgcaccgcctgccagattaatggcgcctcgggagagggcgtataaaccggcaggggctttactataggatgcagccttactggcgctgttaacgctaatagtggcattctctcccaaattaacggtagcgttagttgcatataccgcgtgtgcgctggcaccgttcaccgtaatagtagtgttgttgctaagctcggttctggaggaggatgctgcgtaaatccccgttgaggatgcgccggaggtttcgatggttgcatcgtcacccagacgaatcaacgaaccgctttgtccggtacgcagcccctccgaactgtcgccggtagtaactatatgtgcacacgattgccgacgacaatcgtatttttggcacgtgacgcatcccgcatggcgttagctgtaattccacgtccctggctaccggtcgttttgatatacagatcgtcgccgacgtaaatattggccgatccggtccaaccctggcccagtgagttatatccggcgttaataccgtcaccatcctgaccatccacgtagatgttggtacggtcaccggtaataataaataccgggttatccggagtatttgcgccgtgagtacggatgccatcgacgtctctaccattattcgcggcattcgccgactgcgtccgaatggtcaggtcgttgccaaaaatcacgcccggacttcccgtcccgctgttctgaataaccgtgacagtgtgttcaaacgcctccgcacccggcccattaagcgtgaggccattgccataaaccgggatggtgccggtgttccactgataaacgtagttgggcatggtaccgactttggtgaaaccggtactggcctgagcgggaataatagcctgtaattccggcggcagctggctgaccagcccactggatggcagactatcaacgtcaacccaggccgcctgggagggaaataccatagaggctaatgctgctgataccgctatggcgatgaatgagtaattttggggagttggcattctgcctcctgcattatggcgtaaagcgtcttccacatcgcaataatatggaaataataaaaatggaaacggatctataaaatatttgatattattttatgaatgctatgccctagcttattttcaagccgcagcttatgcacataaagtttcttaatatcaatattgtcaatatttacaatctgctgaatacttattcctgatacaaagtgcttcagtaatataaattccgtatagttaagcgttcgtccacgtttactgttggcaagccgaccggtaaacaagcggtgcatcttttgctgttgcacaatatcatcgtcatcggaataaataattccttgtattttattgcttttcaaaatccagtaattggccagcggagttaaacttctgtcagaaatcaggacaatatgcataccactgtttgccagactgtcagcccattgtaaatcggtaaatcgtcgaagattcgggaaagaaaaatcaacaaagataaaaccgctggataaatggttgtgtctatcaagcaataacttttcaataaacccttttttcaggaaagcattaccatctggccagatggaaaatgccgcattatgacagtattgcacccgtactgcgctgtcagggaataattgacaggataaatcgcaactaatgcaatggacaatttgtgaaggctttctcatcatcctgaacgactcccgtcgatgtttctattaatatttcattggtaaataaatgtgtcaatccagataatatacagtgctacggctgtcaaaagtcgcgaattattgtcagtgtcataaactcctggaaagacctaaaatacagctttaaggaaccatgacagatccgacagtcgtaatacatcatttcggattcgtatttcacccattgagatttttatacataatctccaatatcataaaaaatcttaaaacagcactatttgctaaattatgaggatgataaataacggttctcaataccatctgtctgctgccctcgtcactatcggggtgatgtgatgaaatataaaagtaaatcctgtcaacctgtaatgaattcttattattaaaacctaatttaagattttttcttttattgcattgttattcaatgacttaatggtgaaatttgtgctctcatcaacttcttatatacaaatttaagactattttatagagacgcatgtaaactttaagggggtgtaatgctaatgccatgggaaaatcttgtaacttaacgccgggagtcataccttgccaataagttgatctgacttaattctgaacgtgacagtgtgagcaaccgacagacttatcggtcgaagcaacttcagcttctggcttctcttttcaattgctcatttgatgaaaactctttcccggagcacattagtgagaaacaggatgtggtcaaacccaatgtccatagatgtcgtcagtcacttcagaaatatccgcctcctggcagatatctttaaccgctcgtccagcttcgaccaacttaattacggcgatgttctgatgctcagtgagacgggctttacgcatagagattccttcgtcagcagatcgatgacgtgatctctaaatgtgaatagcacgattatgtgggatacgtacaaaaaattaaactaactgccagtaatatgagtacttggtataagaatgtatacggatatattactactgaaatataataatgggaggggttaagaataaacaggacgtatgggagaacaagggtataaagatgaaatgcttgcagtatctaatagataacaatgaaaaatcaggtaactgagaaactattcagtgtttaggttgatgtgatattgagtcattcagccgctacagcacattatcaggataatttcgtctggataaaacggaggaatgaatcgccacaggtttaacagacaccgctgagtcatttaagatgacttaaagagagaagcccatgagcggtaaacgttatcccaaagcgtttaaaattaaagcggtaaaacaggttattgagcgcggccattctgtttccagcgtcgcaacacgtcttgatattactacccatagtctttacgcctggataaagccgccacattcacgacggcatcatgttgacctgaatctgacggggcatacaggcagttctggctggaatcgggctgtgtttatggctatcgcaagatctgtctcgatctgcgggatatcaggaacaatgcggtgtaagcaaagtctggtggttgatgcaacgtgtggggataaaggctcgggcgatcacaggaatcgtatttgaatgttaacttattgattttatgtttatattttgtattggataaatgagtaacccccataagcaccctcaaatgattttgcttgtggggtttggggacatcctgagctactttttaggctctgttttccactgtaacaaagcggcgatatctttctcaccttcggcttcttttaaacgccgttgttgctcggcaaactggctatattccgcctgcgctttttcatcggccattttcttactgactttacctgccccttgcaaaacctcacggtcgttaaattgcaggaactgatccagcttatcctgccagtcgcgtaaaaagacctgttgacgacgacgggcctgatcttcggcgaaatccagccacatgttaactacgcggttaagctcgctgacttcatcctgagtgagataattttttgccaccgtcacgtcacatttgcgcacctcttcacctttatagctggtcagccccatatgcggctggcaggcgtcagcacgctgatgaatgagttcagcggcggtatacccggtacaggcaaaatgtaacttgttctggatggtttgaaaaaactgcgtggtttctttgagggacggttgataatcggcggccagagcaaagatctcgcgtacccgcaaataaacccgacgttcgctggcgcggatatcgcggatacgctccagcatctcatcgaaatagtcgggtacagccgatgaacccacgggcggatttttcaggcgctcatcgtccatcacaaaacctttgatcaggtattcctggagcgtctgggttgcccactggcggaactgcgtgccgcgcggggagcgaacgcggtagccgacagcgagtatcaacggcaaactaaagtattgaatctgataatttttcccatcactggcagttgttcggtaaaaccgaacaactgaattttcttcaagctcgccatctgcaaagatgttctttatatgctcactgatggtggctttagctttaccgtatagttcgcagatcattccctgagagagccacagtgtattgctttcaaagcggcattcaacacgcactttcccgtcaccgctggcaaacataatgaattcacctgccggggattgggttaagtatttatcttccatgtcgcctccacttacatctgactcgtgatgctgtaatccgcttagtatgccagaaattcctggtgaagctcattacgcagatagcgtttattttggcgggtagcgcccccggatagtgtttcatcacgatatcattcatcttctccaccagatccagacgcttaaacgtgatatgcccactgcctttctgaaagtagtgcatagagaataaatcatcctcaaaaacctgctgatgcgggttatcacgaatgaagtccatcagtcggatagtcacatcgtgtcggttatcgggaatggttttaccatccagcaggaacaacatgcgctccagatccgcaatctggtcacgccgtcagccccaattcaggctgtagccccatcggtcgtgctttaccaggccgttaacgatgatccgcttaccgaagcagcagggattattggttttatagtcccagcttagccctttaaatacattgataatcccacgttcgaaaacatcctgtttattgtggtggagttgttcaaaggtgctcaggatgttggcttcgctgatggccggaagatctcctccttcgagatttttagcccactggctgcgggcttcagcgtccattaaggtcaacatcccggacttcagcatcagatcgcgccaaatgctgcggtcaatattacgggtgatcaccggcatcgctttatcaaccggttgcatcaaccagcagtcaaaggaatggcgctgtcgcatcgcccaatgctccgctacatcaccaccgatgctggaggtaagccgcgagatgtcatcaagcttatgaatcaggatttctatcaggctcagcgcagcgtcgcgccctgtgacgatgcattcaatactggtcgagcaaattagctcattatggtcagttaagacttcagcttctgtttgcatatttttggtccatataaaagcaaacgcgcctgccgggagtggcaggcgcattatgcggtgaaataaaggtgaataaatattgagggtgtaaatcaggaaggcgactcgcaataaatcatgctgtcgccctgaatcaggaatagtggtgttaaattaatgcaggggcgtggctctgtaatacctgttcagcttcttgctggaaaaactggcgtgtaatgctgaagaattcatgcagtttatgatctggcgaagggaccagatcaagctgaagtaattggtgcagatcccagtctttctcaatatgttcttcaaaaagctgttccagctcttcccaatgattacgacgctccgtttgaaggaatccgctgttcaggttcaggtgatcaatggtgtactgtgcgtactcagcttcctgctcagttaaatctattgaaggaaccacatgcccattagataaataggcaaaataacgagaacagtcagggaggtggcaatgaataaactgtgccatatccacagatttattctttccctgtacatgaccaccgaacgtgttgatgccaagctggggcaaaccattctcagagtctaacgcgctggctgcgagattttgataatcgaaggttcgccctggctgctggcttttattttcgacgtgttcaatgtgatagccgaggccacgcaaatcagcacggatttcgctgtaacagcaaagatgatattgctcattgagcagaagcgtcactaaatctgctttgtctcgtctaaagtttcgccagcgacgggtcgattgatccgaatcttgtggtggattttcatttgcagtgagtaaggcatctgtccccggcgagttttgatcacatgcctcattgtgccttccctttcagaaagttacggcatcgacaaacgtagcgcctgcgttaataaacgtaaggctatagtgccttcaagtagatgagtaagctgcgacgttactgctcgtatgaacaccatccacccttatgatgtgagcccgtacccccatgtggatgttgaccctttgggcaggcaagcgcaccggatgatgccgtgacggtaataaaagcgataatcatcgctgtaaataatctcttcatatataactcacattaataaattggaacatattactacctactacagaatacgcatacttgatacggacttaggggataatataacgtgtactttagtttaaattctatccttcatgtggcataggttatcaggataggttttcgttatgaattttatctgggatattgaagcaacatattgtgggggggatatgagttataaatatgttggtaagcatggctgtgatgttgcattgcggatgggctataaagaataccccgatgaaaatgcttatggtgatgcctattatattaaagatgggttaaaatggatatttaatataacaggcttaaaaaaacggcttggcgtatacagcgacgacgatctccgtaaacagaactatgatgtagatacctattatcgggttgaaaaccaacaggaagaaagtgcagatgatgaaatgcaatcgctatatcataatttagcggtagaagaaggagaacccgtgtatctggagggaggcatgtatctttatccggatggctctatacgttgatctcataattttggtctggtaagcgttatctcttttgagaaaggatgagtctgtaagtatgacccacaagctcgtttggtgattagttaagtcccgcccgcgttagtcctggcgtacttttatcccttctttgcggacgatatcccacaataaatggacgttcggttttagcaatcggtaaatggtgattaataaaataatattccactttctctctccacctttcctttcgtattatatgcaagaactagtcttaataataagcaaatactttgtcccgaaatagaggacgaatggtgggcatgagagaaggattttggcggaagatcacaggagtcgaacctgcccgggaccgctggcggccccaactggatttgaagtccagccgcctcaccggagacgacgatcttccgcgcctcgattgctacatggaggcgcgcgcattatagctacttcctggcgtttccacatcccctcccgtgcttttttaacttccctttccttctgccatgatcggtttcatataaacccccataaaatccattagttacatttcatcacactttttggcgctaccctgatcacagaaaacaagaatcgtaatttgataaccaaataacggaatattcacgctcgcagggaaggtttacaaaaactgtaaccggtatcagtgagcgttgtgagcgttaaggatgcgtaatgaaaagtgaaattctctccgttaaggagaagattggctatggtatgggcgatgccgccagccacatcatctttgataacgtcatgttatatatgatgttcttctataccgatattttcggcattcccgctggttttgtcggcaccatgtttttactggcgcgtgcgcttgatgccatctccgacccttgcatgggcctgttggccgaccgtacccgctctcgctggggcaaattccgaccctgggtgctgtttggcgcgttgccgtttggtatcgtttgtgtgctggcttatagcacgccggatctcagtctgaacggcaaaatgatttatgccgccatcacctacacgttgctcacccttctgtatactgtggtcaacatcccttactgcgcgttgggtggtgtaataaccaatgacccaacgcagcgtatctccctgcaatcctggcgctttgtgctggcaacggcgggcggaatgctctctaccgtactgatgatgcctctggtgaaactgattggcggcgagaataaggcgctgggcttccagggggggatcgcggcgctctcggtggtggcgttcctgatgctggcgttctgcttttttaccaccaaagagcgcgttgaagcgcctgccacccatacctccatgcgtgaagacctgcgtgatatctggcacaacgaccagtggcgcatagtcggcctgctcaccatcctgaatattctggcggtatgcgtgcgcggcggggcgatgatgtattacgtcacctggatattgggcaaaccgggcgtgtttgtcgccttcctcaccacctattgcgtcggcaacctgattggctcggcgctggcaaaaccgttgaccgactggaaatgcaaagtgagcgttttctggtggaccaacgccttactcgcagtaatcagcgtggcgatgttcttcgtaccgatgcacgccacgatcgctatgttcgtctttatcttcgtgattggcgtattgcaccagttagtcacgcctatccagtgggtgatgatgtctgacaccgtcgactacggcgaatggtgtaacggcaaacgcctgacggggatcagttttgccggcacgttgttcgtgctgaaactgggtcttgccctcggcggggcgctgattggctggatgctggcaggcggcggttacgacgcggcggcgaaaacgcaaaacagcgccacgatcagcatcatcatcgctctgttcactatcgtcccggccatctgttatctgctgagcgccgcgatcgctaaacgctactacaccctgaaaagcccgttcctgaaaaccattctggaacaactggcgcagggcgcacaccgcaacgaacaagaatttacccataaagaattgcaaaactaaaggaacagactatgaaaattagcgacggaaactggctgatccagcctggccttaatttgattcacccggttcaggtgttcgacgttgaacagcacgggaatgagatggtggtctatgccgcgccgcgcgatgtccgcgaacgaacctggcaactggataccccgttgtttaccctgcgctttttctcgccacaggaaggagtgataggtgtacggatggaacacttccagggcgctttggataacggcccacattatccgctcaatgtcttgcaagatatcaacgtggagatgcagaacaacgccgaatttgccgaactcaagagcggcagcctgagcgtgcgtgtcaccaaaggcgagctctggtcactggattttctgcgcaacggtgtacgtatcaccggtagccagttgaagaataacggctatgtgcaggataccaacagcgggcgcaactacatgttcgagcgtctggatctcggcgtgggcgaaaccgtctacgggctgggcgagcgctttaccgcgctggtgcgtaacggtcagacggtggagacctggaaccgtgacggcggcaccagcaccgagcaatcgtacaagaatatcccgttctatatcaccaaccgtggctacggtgtgctggtgaatcatccgcagtgcgtgtcgtttgaaattggctccgagaaagtctccaaagtccagttcagcgtcgagagcgagtatctggaatacttcgtcatcgacggcccgactccgaaagacgtgctgaaccgctatacccaatttacgggtcgtccggcgctgccgcccgcctggtcgtttggcctgtggctgaccacctcatttaccaccaactacgacgaagcgaccgttaaccgctttatcgacggtatggccgagcgcaatctgccgctgcatgtcttccacttcgactgtttctggatgaaggccttccagtggtgcgattttgaatgggacccggtgactttccccgatccgaaagggatgattcaccgcctgaaagcgaaagggctgaaagtctgcgtgtggattaacccctacatcggccagaaatccccggttttccaggagctgaaagagaaagggtatttacttaaacgcccggacggctccttgtggcagtgggataaatggcagccgggactggcgatttacgacttcaccaacccgcaagcctgcgaatggtatgccgacaagctgaagggcctggtggagatgggagtggactgcttcaaaactgacttcggcgaacgcattccaacggatgtgcagtggtttgatggttcagatccacagaaaatgcacaaccattatgcctacatctacaacgaactggtgtggaacgtgctgaaagagaccgtgggcgttgaagaggcggtgttgttcgcccgttccgcctcggtgggcgcgcaacagttcccggtgcactggggcggcgactgctacgccaattacgaatcgatggcggaaagcctgcgcggcgggctgtccatcggcctgtcagggtttggcttctggagccatgatattggcggattcgagaataccgcgccggcgcatgtctacaagcgttggtgcgcattcggcttgctctccagccacagccgcctgcacggtagcaaatcctaccgggttccgtgggcctatgacgacgagtcctgtgacgtggtgcgcttcttcaccgaacagaagtgccggatgatgccgtatctgtatcgggaagcggcgcgcgccaacgaagccggtacgccaatgatgcgggcgatgatgctggagtttccggacgatccggcgtgtgattatcttgatcgccagtacatgctgggagatgcggtcatggtagcgccggtatttagtgaagcgggcgacgtggagttctacctgccagaaggccgctggacgcacttgtggcgcaacgatgaagtgcagggcagccgctggcataaacagcagcatgacttcctgagcctgccagtgtacgtgcgtgacaatacactactggcgctgggcaacaatagccagaagcccgattacgcctggcatgagggtacggccttccagttattccatctggatgacggttgcgaagcggtctgcgaagtccctgctacggatggttcgacaatctttacgctgcaggcgaaacgcacaggcaataccattacggtgagcggcgaaggcgaggcgcgcaactggacgctgtgtctgcgtaatattacgcagattagcggtaccaaatgcggctcatatgcgggaagtgaactgggcgtagtggtcaccccgcagggaaatgaagtggtgattacgctttaaatctgaatcgccggatggcgccgtgagctgcgcttatccggcctacaaatgagcaagaaccgtaagcccggtaagcgccagcgccaccgggcaagccctcaattacagcgctggctccgttgacgtaacttccccgccggacaccacacccgcttgcatcgtttgcattatctgctgcttttgtgcgttgaccgcgtgtaattgcccgtttaccgtcggtttcaacggcgcatcggcctgaatattgccgctggccgtgaactgaatattgccatcgccagcaatcggtaatgccggccagccccactgttgtagcacatccattggtacgccgcgtccgttcaggctgatttgcgtctgacgctgcggctgttgtgatacgctggcagtggcttccagtatccctttttcagtaaacgcgctcagatcactgatgttgaccgtgctggcattcgccgtcaacgacagcgacgggcggcgcacgtccacacggttaaaggttgccgctgcggcgttgagggtcgcattgccgctccagacgccccattgatgatgttgtaccagctccaggtttgcgccgtagccgtccagagcggtgatttgccacgggaaggtcgggtcgatatcgatcaccagattgcggctggcgctgaattttttcagcgtcaggctgttcagccagtcgggcaacggcttcatccataactgcttccagttttccggcagcgtatactccagcccggcgatagcggtatcgtccagaatcagcgctttgctctcgcgtaaccaggcgccggaggttctgaccataccgccttcccagcgggtggtgaactggcgtagcgcaacgccctgtggtgaaaattcggcgttcaggattggatcgagcaagtgcagcgagccgtaaataaactcgctggcattcatcgataatttaccttcctgactttgccagtcttctttgcgcagagtcagattgcgcaaactcaggtcaagatcggtgactgcccagtctggtccttgcaggctggagtccgtcacttcaagacgaccaatctgcaaagatggaaccgtagtaagcggcgcgaaaaactcgctcagggatttatcgctttgtaaccggatatcattcagccgcagattttcaacgacccaactaccatcagcgttacgccgggcgacgccggttaacgctccgcgcgccatatcggcgccgacggtgtttaacatcatctgatcatggtcaatactgccttcaataagcacattcgtggcgggaacgtcgtttaacgtcagcgaaccggcgctcagttggatctgggctttattgcccaatacccgaccggcttcggggcgccagggcataacgccgccgttaacgcgctgggcgctcaaccgccattcgctgccgggactattgagcgccatattgcgaagttgcaggcggtcggcctcaaacgggaaaggggcggtttgcactgaaatattcagcgtgccgtcctgtaacagaatcgtgtcgacatgcagcggcgcggttaactggcgaatgctcagaccgatatctacggttttcgcgaccagggtagcaggctgaccatcacgaccaaaggtcacattctccagtaaaagatgggatggggcggaaaaacgatgatccatcacgtcgaatgtgaggtgatagccgctgttctctgatacccagttgctgacatgatctgcgccccagcgcgtttgcagcagaaaataaaagccgaaaatcaccactaaacaggcgatcagcacgtagagaagcaacctcccaatcaatttcatggtcttccatcccgtgaaatgcacataggggatttatgcacgatttgcgtgcaatcctcaagacaggaatggtgaaagagcgttacagcagcggcgaatcgtgtcgccgccgcagggtttttacggtttttccggcgggagaatcaggttcagcacgatagccgtgatgccgccagcggcaattccggatgagagcagatttttcacccattccggcgcgaactgcaggatctgcggctgttgcgagacgccaagacccacggccagcgacagggcgataatcagaatcgcgcggcggttcagcggctcacgcgagacaatacgcaccccggaggcggcaatggtgccgaacatcaccaacgtggcgccgccgagcaccggttccgggatatgttgcacaaaaccgcttaccgccgggaacaggccgagcacaatcagcatcagcgcgacgacaaatcccacatagcgactggcgacgccggtcaactgaatgacgccgttgttctgaccgaaacaggaattcgggaacgtattaaataccgctgaaacaaatgagttcaggccgttagccagtacgccgccctttagccgtttcatgtacaaggggccggataccggctgctcggagacatcagaggtggcggtgatgtctccgatggtctccagcgacgtaatcataaagaccagcatcaacggcagtaacaggttccagtcaatgcccagaccataatacagcggggtcggcaccatcaggatgtcctgcgagaccggcgcgttattctcaggcaacatgcccataaaccaggccaaaagatagcctgccgccatggcaataaccaaagaagccacgcgcaggtagggattacgttgccgattcagcaggatgataatggccaggacgacgccggccagtaacaggtttttcggtgcgccaaaggtgttgtcgctcatggcggcatagccgccgccgatggaagttagccccacctgaatcagcgacaggccaataatcattaccacgacgccggagactaacggcgtgataatccggcgcgccagatgtagaatgcgagaaagcaccatctcggtgcagcttgccagcatcagcgtgccgaacagcgccgccatcatcgtcgggacatccgcgccgccggttttcagcgcggtaccgcccataatcagcggggcgacaaagttaaaactggttccctggatggataacagccccgatcctaccggcccccacgctttgatttgaataatagaggctacgccggaggcgaacagcgacatgctgataatgtgctgagtatcctgcgccggtaaacccaacgcctggcagattaacagcgctggcgtaattaccgcgacaaacatggccagcagatgctgacaagcggcaaaaagggtttgagggagcggcgggcgatcttcaagacggtaaattaattcgctgttttgcgtctgcgcaaccggttgcgcatctgccggctcgatggcgttaacggacatcagggacattctcgtggtggaaaagcggtgattttatctgaccaggtggtaaaagcaaacgattgcgagcgaatattcttaatatttaaaaaagataaatgcaccttttatataactttttgcctttttctgcttaaaatccatgccgaagactcgcaaagagctaaaaaactgactcaggaaatgatttgtgcgcacatgtcacagcgcactacaggagctttaaatgtttgaactcgataccttatcgacccttgtcgccgccacgctggtgctgctactgggtcgcaagctggtccagtctgtctccttactgaagaaatatacgattccggagccggtggcgggggggctactggtcgcggttgctctgctggtgctgaaaaaaagcgtcggttgggaggtcaactttgatatgaccctgcgcgatccgttgatgctggcgtttttcgcgacgatcggccttaacgctaaccttgccagcctgcgcaaggggggacgcgttgttggcgtcttcctggtcgtcgtggtcggattactgctgatgcagaatgccatcggtatcggcatggcgagtctgttggggctggacccgttaatggggctgattgccgggtcaattacgctgtccggcggacacggtaccggcgcggcgtggagtaaactgtttgtcgaacgttatggttttgccagtgccaccgaagttgcgatggcatgtgcaacctttggcctggtgctgggcgggttgattggcggcccggtagcgcgttatctggtgaaacactccaccacgccggatggaatgcctgacgatcaggccgtgccgacagcctttgaaaagccggatgtgggtcgtatgatcacctctctggtgctaatcgaaactatcgccctgattgctatctgtctgaccgtgggcaaaatcgtagcgcagctactggcgggaacggtgcttgaactgccggtcttcgtttgtgtgctatttgttggggtgatcctcagcaatggcctggcgctggtgggtttttatcgcgtatttgagcgtgctgtttcggtgctggggaacgtgagtttgtcactgttcctagcaatggcgctgatgagcctgaagctgtgggaactggcgtcactggcgctgccgatgctggcgattctggtggtacagaccatcttcatggcgctgtacgcgatcttcgtcacctggcgcatgatggggaaaaactatgatgcggcggtgctggcggcgggtcactgtggttttggcctgggcgcaacgccgaccgccattgctaatatgcaggcgattaccgaccgttttggcccctcgcatatggcgttcctggtggtgccaatggtcggcgcgttctttatcgatatcgtcaatgcgctggtgattaagctgtacttgatgttaccgattttcgcgcaataagggtttgtacggcggcattaaagccgccgtgctcactaggcgttagaataacgttcggtttccggcatccagcgctcaatcagcgcttgtgcctgctgcggataacgttcgtgaatatgacgggcaatacgctgaacttcgggaatcatggcttgatcgcgcagcaaatcagctactttaaattcggcgttacccgtctggcgcgtgcccagtaattcccccgggccgcgaatctctaaatctttttgtgcaatcacaaagccgtcgttgctgtcgcgcaatacctgtaaacgcttctgcgccgttttcgacagcggcgatttatagagcagcacgcagtgcgatgcgaccgcgccacggccaacgcgccctctgagctggtgtaattgcgccaggcccagccgctccgggttttcaataatcatcaggctggcgttaggaacatcgacccccacctcaatcaccgttgtggcgaccagcagatgcagttcaccctgcttaaaggcctgcatcaccgcctgtttttcggcgggcttcatgcggccgtgtaccaggccgatattcaactccggtaacgccagcttgagctcctcccaggtggcttccgccgcctgcgcttccagcaggtcggactcttcaatcagcgtacagacccagtaggcctgacggccttcggttgtgcaggcgttgcgcacacgatcaatgatttcatggcgacgggtatccggaatcgcaacggtagtgacaggggtacggcccggcggtagctcgtcaatcaccgaggtatcgagatcggcgtaggcagtcatcgccagggtgcgcggtatgggcgttgcggtcataatcaactgatgcggatgaaagccctgctgctggcctttttcccacaatgccagccgctggtggacgccaaagcggtgctgctcatcgataatgaccagcgccaggccgttgaactgcacctgttcctgaaagatagcgtgggtgccgacaatcatctgcacctgaccgctggcaatagcctcttgctgcgcctgacgcgctttacctttttgcttacccgccagccaacccacttcaacgcccaacggttcgaaccagttgcggaaattatttgcgtgctgttcagccagcagttcggtcggtgccatcaacgcgacctgcttaccgtgggcaatagcgcgcaaggcggcaagcgccgcaaccagcgttttccctgagccgacgtcgccctgaaccagacgcatcatcggcacatccagcgccatatcacgttcgatctctgctaccacccgcgcctgcgcgctggtgggtttaaacggcaacgacgccagcagcttgtctttcaatatgttgttggtacttagcggctgagtgtggtagcgctgcgcgcctgcgcgaagcgccagcatactgaggttatgcgccagtagctcttcaagaataagccgccgctgagccgggtgtttgccggtttctaaatcggcgagctggagtgtcggcggcgggcgatgcaaggtacgtagcgcttccggcaggctcatcataccctgcgccagttccggcggcagtagttcggcaatggcgcaggtgtcgagcaactccagcgcctgatcggtaagcttgcgcagtgtcgcttgcttcacgccctcggtggtcggatagacgggggtgagcgtttcctgaagttccggcgtgctgagatcgccctgcaggcgatattccggatggatcatctctgcgccatacttgccgcgcttcgcttccccgtaggccagcacacgccgccccgtcgccaggctgtttttcatcgccgcgttaaaattgaaaaagcgcatggtaagaatgccggaaccgtcgctaatctggcaggtcatcatccggcgaccgccgaaagtgatattgcagttcagcacttcaccttcaacggtggcgtagatgccaggcagcagttcgccaatggggtagagatgggtacggtcttcgtaacgcagaggaagatgtaatagtaaatcctggacggtatgcaggccaattttcgccagtttactgctttgcgctgcgccgacgcctgtcagggaattgagcggaacagcgtctaacaagcggcctgacatggtgattaccctgccgcctgcatcgtcgcccaccagtcagcatcggcgtcgatttcgccctgctgattgacgcgaggataaggcagacctttacgtttagcgactttcgccagcaccggataaccaccctcaaacagcaggcgctgctgttcatcttccggcaacatgctattttcacgcagatacatgcccgcgttctgtcgctggcgctgggcttcataaagaatgagcgcggaggcgacggaaacgttcagcgactgtaccatgccgatcatcggaatgatgatgtcccgatccgccaggtctaatgcttcctgagtaataccggttttctcctgacccatcagaatacaggtcgggcgcgtgtaatcaatctcgcgaaagtctacggccttatcagaaagatgggtggccagaatctgcattccccgtcctttcaaatgggctaccgcatcgtcaatggtacggtgagttttcacctgtacccaactgttgctgcccgccgccgcggaagccatggtgcgcatccggctaccaggccagatggcatggacttcatggacgccaacggcatctgcggtacgaatgattgcagaaacgttatgaggtttgtggacttgctccatgcagaccgtgagatcaggctgacgcctggcgagcatttcgcatatacgcgcataacgttttggattcatagcgctagtttcggttacgggtgactttaataacgtctggcatcacgcggattttgcgcatgatattcgccagatgtacgcgatcgcgtgcggtaaggcgaataaaggtactatagacgcgaccatctttttcttcagtattcaggctttgaatattggaggtggtggtattaatcgccgccgtcaggttagccagcgcgccctgatggttaaacatttccaccttgatttcggtaatgaattcctgctccgtctctttgtcccattcgaccgccataaatttctctggctctttctggtatccacggatattacggcaggattcatggtggatcaccagtcctttacctgggctgacgtgagcgatgatcgggtcgcctgggatcggacgacaacacttcgcaaaggtgataagcacgccatccgcgcctttaatcggcaggtggccgtgattcgattgcgcaacggtcggcaccacggcttcgccttgctgcagatttttcgcgaccactacgctcatcgcgttgccgagaccgatttccgccagcagatcgtcaagcgttgccagcttcatacgatccaattcgcgctgaatattttcctgcggaatttccgccagcttacgactgccgcctaaagcatggttaagcagacgacggcccaggcttacggagtcatcacgtttgaggtttttcagcaactgacgaattttagcgcgcgctttagagctgacgacaaagttcagccaggcggcgttgggacgcgcgcccggcgcggtaataatttcgacggtctgaccgctgctaagcggctgtgacagcggataaggctgccggtcgacacgcgcgccgacgcaggcgtggccgatgtcggtatgcactgcataggcaaaatccaccggcgtagcgccagcgggcagttcgacaatgcgcccttccggggtgaaaacgtaaatctcatccgggaagagatcggattttacgctttcgataaattcaaacgaactaccggcgctctgttgtagctccagcaggctctgcatccagcgctgggcgcggatctgcgccgtggtgctggtctcaccgtgctctttatacgcccagtgcgccgcaacccccatttccgccatctgatccatgtcttcggtacggatctggacttcaacaggaacgccgtgcgggccgatcatcgaggtgtgcaaagactgatagccgttcgctttgggaatggcgatatagtctttcacgcgtcccggacgcggcttatagagactgtgcatctggccgagtacgcgatagcaggtatcggagtcatgaacgatcacgcggaaagcgtaaatgtccatgatcgagtgaaaacgctgctctttgagcaccattttgcagtagatcgagtaaagatgtttttcgcgaccgctaacgcgacacggaattcccgcctcttgcaaacgtccttcgatttcagagaggattttttggatcatctctttacggttgccgcgcgccgctcttaccacttctttaatgacgcggtaacgattgggatacagcgcttcaaaacccagctcttccagctcggttttaatatgatgaatacctaaacggtgcgccagcgggctgtagatttcgagggtttcacgggcaatacgacgacgtttatccgggcgtaacgagcccagcgtgcgcatgttatgggtacggtcagcaagcttaatgaggatgacgcggatatcctgcaccatcgccataatcattttgcgaaagttttcggcctgcgcctctttcttatcgcggaacttgagcttatcaagtttcgacaccccctctaccagctcggcaacgcttttaccgaaaagctgttccatgtcctgataggtggcgggggtatcttcaatcacgtcatgcagcagagcggccatcagcgtttcgtagtcgagtttcatctcggccagaatacaggccaccgctaccgggtgcgtgatatagggttcaccgcttgaacgtgtctggccctcgtgagcgtcacgtgcaacgagatacgcctgccgaagacgcttaatctggtcttccggcaggtaggtttgaatcagttgattcaggctttcaaacagatacaagggcgacccgctttgtgattaacgacgaccttcagcaatagcggtaacggcttgtaattcagcggcttcctgctcttgctgttcctggcgctcgcggacgtcgaggatctggttgttaatcagaccttcttcgatttcgcgcagcgcgataacggtagttttatcgttttcttccggtaccagcggatcctttccgcctacctgcatctgacgagcgcgacgcgcggcgaccagtaccaggtcaaaacggttaccaattttctctacagcgtcctgaacagttacgcgtgccatacttaaaatgctccacaggtgaagaaatgactgggcatgatactgaaagtgggttcagtctgccaacaatttgctgattaaagcgtcatgacgctgcttttggcggctcatacgcagacgttcagcgcgaatgatggttttcaagtcgcttaacgcggtatcaaagtcgtcattcacaataagataatcatattcggcgtaatggctcatttctgcaaccgcttgcgccattcgtttggcaatgacttcttcgctatcttgcccgcggccgcgtaaacggcgatccaattcgatctttgatggcggcaaaataaaaatgctgcgtgcttgcggcatcttttcgcgaatttgctgggcgccctgccagtcgatatccagaaaaacatcaacgccagttgccagcacttgctcaatggtttcgcgcgaagtgccgtagtaattgccaaacacttccgcgtgctccagaaacgcctccctgccaatcatggttttaaactcatcatgatttacaaagaaatagtgctcaccgtgcacttcacccggacgcggcgcgcgcgtggtatgtgaaacggaaacctgagtgtcgtacaacggttgggtttttaataaagcctgaatcaggctggatttacccgcgccactgggggcagaaacaatataaagcgtaccttgagccatgagtatcttacgtctgtgattatcgaaatagagccttgatacgggcttattatacacatcgccgttatgcgacgtagtctttgtcacactttttgcgccagattattgcattttgcgtccctttttccgcttttatcgcgtcgttgcagcaacccaccaaaaaatctggaaagcggctcggatggtgcatttttacctgtcggtttttattcactaaagcgctatacctgccgggcaatgtgcgcaggaggttgtgatgagattatggaaaagtatggcgtggggaattttattgtggcattcgcagagtggggcgctttgcccggcctggccgccagcaagggccgctgaagaaatcacccgtttacagcaacagctcgctgactggaatgacatctactggaaacaaggtgttagcgcggttgacgatagtgtgtacgaccaactcagcgcaaggctggttcagtggcaacgctgtgttggtcaggatgtttcatctactccggtttcaccgccgttaaacggtacaacaatgcaccctgttgcgcacacgggcgtacgtaaactcgcggaccgacaggcgtagaacagtggatgcgcgggcgcagcgagctttgggtacagccaaaagtggatggcgtagcggtaacgctggtttatcaaaacggtaaactgaccagggccattagccggggtaacggactacaaggcgaggactggacgccaaaaattcgcctgatcccctctataccgcagacaacacaaggcgcgctagctaacgcggtgttgcagggcgaaatctttctacagcgcgagggacatatccagcaacggatgggcgggatgaatgcgcgctcgaaagccgcaggaatgttaatgcgccaggataacgcctccgcgctaaattcgttgggtatttttatttgggcgtggccggacggtccggcaaatatgcccgaaagattaagccaacttgctaaggctggattcagtctgacgaagaaatattctctggcggtaaaagatgccagcgaggtcgagcgggcgcgccagtcatggctgacgtcagcattaccctttgtgacggatggcgtagtgatacgcatggctaaagaacccgcgtcacaatactggcgacccgggcagggcgactggctggcagcatggaaatatccgccagtagcgcaggtcgcgcaagtgagcgctattcagttctcggtggggaaaagcggcaagattaccgtagtagcgtcgcttgtccccgttatattggatgataagcgggttcagcgggtcaatatcggttctgtgaagcgttgggaagcgtgggatattgcgccgggcgatcagatcctggtgagtctggccgggcaaggcattcctcggcttgatgaggtcgtctggcggagtcgtgagcggagtaagcctgtgccgccaggtagccatttcaactcgctgacctgcttttacgcgtcggcaacgtgtcaggaacagtttatctccaggctggtatggctggggtcacggtcggcgttgggtctggacggaatgggtgaagctagctggcgggctttgcatcagacgcatcgctttgagcatatcttctcctggcttgccctgacgtcagcgcaaatagccaacacgccaggcgttgctaaaggaaaaagcgagcagatatggcggcaatttaacctggcgcgccggcagtcatttacccgctggatcatggcgatggatatccccttaacgcaggccgcattacaggccagcggtgatcgctcatgggagcagttattaatgcgaacagagcaacactggcggcaattgccagcgacgggcgagcgccgtgccgggagagttatcgactggcggaataatccgcagatcaacgcgctgagcagatggctggctactcagcatattcccggatttgggtcttagtgtccttcatgacggtaataaaataccggcaggccaagtttaagacgtagcgctaataaccttgctgtaaagccaaacagtagcgtagagataacgacgacatccggattcatgacgtaatgttgtagcgcaatatagagcaccgccgaggcgaacgaaatgccggcatacagctctttttgaaacaccagtggaatgcgtttgcagaacatatcgcggagcacgccgccaaagacgccggtagtggcggcggctaccacggcgataattggcccttcgcccatatcaagggctatctgagcgccaataatagagaaaaccaccaaccccagcgcgtcaagtaccaggaaaagcttgcgtaaatagggcatgacgggagcaacaatggtggtcaatacggcggcagtcgccacaataatgacatattcgggatgcttcacccaacccagcggatagtgaccgagcagaatgtcgcgaaccgagcctccaccaatggcggtggcggtagcaataataattacgccgaatgtatccatgcgacgacgacccgcagcgagtgcgcccgtcatggcctcggcagtgatgccaattaaataaagaacgtgcaacagcatgatttccccctaatttactgggggcgaagattaacgatttgtgcgctgtatcacgattgagattttctaaggcattacacgattaataaattttagtaatgattctaaatttatgattaataattatttattataaatatcaataaattgaacatcatttttgtggtttattgtatacgaggtttttctgttttgacttagataaattacctgaacggcgccctggacgcgccgccggtgagtcatttcattgtggctgctgtgcggtaagttgtgtgatgaagcgctgacgcgagcgttccacatactgttgcaagccattggaatcaaagaatgcctgtgtatcgccgttgcgaagttgctgtcgtttctccagtagcccgaagcggtcacctttgttggcaataaagatatcaacatgctgggcggccagtgttttaaagctgctctgaatatcagtaaccaggtcagggtaatttttgttgttaatcagcagatagtcaggtgtggcgagactatctgcgtaaattagcgtcttgccgttgcggagcgttacgcgccaggaggttgagccgggcagatgtccaggcgtgaatagtgctgtcacggttacccctccgaggctgatgctttcctggttgtggataattttatcagtggtgacgagcgggaaggggagcgcatcgccaagcgcaaaatcctgtcgtccacccctcgccatctgatcggcgttgggttgactggcgaccaattgtgcgccgctccacgctttcaaacgtgccatgccccccgcttgatccagccgcgcatggctgctcaacagatagcgcacgtcagtgaagcgaaatcctgccgcttcaatattcgctttaatttgcggtgcgctttcatccagccccgcatcaataagaatatgccctgccggagtggtcagcagaatagaagagagattttccgtaccgacataccacacgccttctgtgatttgaaacggcttcataggcttagcccacgctttaaacagtgataacggaggcgcgggtgataacggttgtgaaggatctaatgccgccatggcaggaagtgctgatgttgaaaatatacatacaaagaataatacatagcgattcataatgttctcctgattgaagcgcccgcagtatacctggcagtaatttagtcaggttcaataagagagacgtttaatgaacttgctgcaaatggatatgaacctgttaaaagtactgtatgtgctgctggagacgagctctacggggaaaacggcgcaaaagctggctttgtcgccttctgcggtgagtcatgcgctaatgagattgcgcgatgcgctaaacgatccgttgtttcgacgggaggggaaccgccagattgctacgccttatgcgcaggcgctgcgtgacaagttggcgcctgtgtttgtttcgcttaatgaggagctgtttggcgataaagagaacggctcccgttgtttccgggtggtacttcctcccgcattgaacgcgctgcttacgcccgttctcgcagagaaaggtcatcttcatcaggcggtgatcgagtgccttccttttgcccgccgaccctggcgtgatgaactgttggatagctcggttgatttggtgctggcaattggcgaccatcaaaagcaggtcagcgctctgcattacgagcgggtggggacgacgcgtttgatcgcggtttatggcgcgccattgcgttcacgtctggagaatgccgcagcgttgaattttgctgatctgcagcattatcaacacatttactgtttgccgtggacaaaagagaacaacgaactggacaggcagcaggctcgtgccgggtttgaacgtccgttggcgtttgtttgtcatgattacagtcaacttgcgcctgctgtccagtcggcgccgctaatggcgattgtaccgcgcccctggtatgaaaatttatccgataagcgcggtctttttgtcctgccgcttgccggggagcaggcggaaggcgctatttttatgcagtatcgggcttcgacggtagagtggaagcgacgccttatcgacgctattcgccggaaattaaaaacgtactaccgataaacgcgagagcccgcataaggcggactctgtgacatattgagcgccagaattattcaatattctggatctgctcgcgcatttgctcgatcaacacttttaattcaatagcggagttagttacatcagcgttgatggatttagaggccagggtgttcgactcacggttaaattcttgcatcatgaagtccagacggcgacctaccgcctcttttttcttcagaatgttgtaagtctctttgacgtgcgcttcgagacgatccagctcttccgccacatcaatgcgctgcgccatcatcaccagctcttgctccagacggttgttttccaactgaacctgagcatcttccagcttcgcgaccaggcgttcacgctgccattgcaggatttccggcatatgcgcgcggactttcgctacttcggcgctgacgccttccagacgttgttcaatcagcgctttcagcgcctggccttccgtttcgcgcgcgacgataaagtcatccagcgtaccgtccagtgcggctaaaatttctgcggcaatcgcgtccagatcctgctcttgcgccgccatgacacctggccagcgcaaaatatcaaccggattgatttccccttcgtcgctctgcattttgacccagtttgcggcgctaactaattgtttcgcgagcttttcattcagaataagctcgccttgcgcgctggcatcgggttcaaaacgcagcatacattcgactttgccgcgcgtcaggcgtgtacgaatgcgttcgcgcacgacgggttcaagactacggaactgttccggcagacgaaagtaagtttccagataacgctggtttaccgagcgcatttcccaggtcgcgctaccccattcacccttgatttcacgccgggcgtaggcggtcatactgcggatcatagatgttcccgtttttaaaggagagatgaggggattatagctatccatgccttgtcaggataggaataaccatcggaagtccgtataatgcgcagccacattcgttttaagccggagatctcaatatgcgtccagcaggccgtagcgctaatcaggtgcgtcccgtaaccctgacccgtaactatacaaaacacgctgaaggctcggtactggtcgaatttggagataccaaagtgttgtgcactgcctccattgaagaaggcgttccacgttttctgaaaggacaaggccaggggtggatcaccgcagagtatggcatgttacctcgcgctacccatacccgtaatgcgcgcgaagcggcaaagggtaagcagggcggtcgtactatggaaattcagcgtttgatcgcgcgtgcgctgcgtgcggcggtcgatctgaaaacgctcggcgaatttaccattacgctggactgcgatgtaatccaggcagatggcggtacgcgtacagcgtctattaccggtgcctgcgtggcgttggcggatgcgctgaataaattggttgccaacggtaagctgaaaaccaatccgatgaaaggcatggtggcggcggtttccgtaggcatcgttaacggcgaagcgatctgcgatctggaatatgttgaagattccgccgcagaaaccgacatgaacgtcgtgatgactgaagacggccgcattattgaagttcagggtaccgcggaaggcgagccgttcagccatgaagaacttctcactttgttggcgctggcccgagggggaattgaatccattgtggcgacgcagaaggcggcgttagaaaattgattttaaggcgactgaaaagtcgccttttttttgtccgtaaatttcgtaaatgatgaaagtaagaaaaggagcgaatccatgaaaccgtatcagcgccagtttattgagtttgcgcttaacaagcaggtactaaagtttggcgagtttacgctgaaatccgggcgcaaaagcccctatttcttcaacgccgggctgtttaataccgggcgcgacctggcgttgttaggccgtttttatgccgaagcgctggtggattccggtattgaatttgatctgctgtttggccccgcgtacaaaggtattccgatcgcgacgacgacggcggttgcgctggcggaacatcacgataaagacctgccgtactgctttaaccgcaaagaggcaaaagatcatggcgaaggcgggagtctggtgggcagcgcgctacagggccgcgtgatgctggtggatgacgtgattaccgcaggtacggcgattcgcgagtcgatggagattattcaggcgcacagggctacactggctggcgtactgatttcgctggatcgtcaggaacgtggccgcggcgagatttccgcgattcaggaagtggagcgcgactatggttgtaaggttatctccatcattacgctgaaagacctgattgcctatctggaagaaaaacctgatatggctgagcatctggcggctgtgcgagcataccgggaagaatttggcgtgtaagcgaattgcccggtggcgctttaccgggcctatatttctgtcgcctggataaggcgtgagccactatccagtcagcgttactgcaactgcgcggcaatgagcggccagcgggcgtcgaaatcgtccgttgggcggtatttaaattcgctacgcacgaaccgtgaaagcataccttcacagaaggctaacagctggcttgccagcagatttttatccgtcgtgtagccttcgccttcacgcattcttttttctcgtagcacctggcggagctgcgcttcgatgcgttcaaaaagctgattaatgcgcccctgcaggcgatcctgttcaaacatcagcgcatgcccggtaagaatgcgcgtcaggccagggttgcgttcgccaaaacccagaatcagtaacacaatcaggcgcaaacgcgtgctggtgtctttttcatcttttaaaatcagattgatacgggtaatcagactatcttcgataaactcaatcaggctatcgaacatgcgggtcttgctgggaaaatggcggtatagcgccgcttcggaaacgccgaccgaggccgccagttttgccgtcgtgatgcgttggcttccatcgctggattcaagcatcagcgccagtgactgaagtatttcttcgcgacgattccttttcgcagtttgtttttctgccatgttacaaaatacccctgaaaataagcacttgccaggcgagcacccacgctataaccgcaaactcagcgcttgcggcagtattatgacgttatggggatgcgtaaaatttacttacggccagaatgaccgaagccgccctcgccacgttcggtggcgtcaaatgcttccaccagattaaattcggcctgaacgaccggaacaaacaccatttgcgcgatacgttcgcccggttcaatggtaaaactgtcctgaccacggttccagatcgaaaccatcagttgcccctgataatcggaatcaatcagcccgaccaggttgcccagcacgataccatgtttatggcccaggccagaacgcggcaacatgactgccgccaatgatggatcggcgatatgaatggccagtccggtaggcaccaacgtcgttgcgccaggcgccagttctacggcgtcgtcgagacaggcgcgcaggtcaagcccggcagaaccagaagtagcataagtcggcagcggaaactgctgaccaacacgcgggtccagaatcttaacgtcgatttttttcatcataacgggtcacgatctcgtcgagtaataattggcccaggagttcttttcgctcaagcggtaagactttatctccatcctgccagaaaaggtgtaaagcgtttttatcgctattaaatccctgatttgaaagagaaacatcatttgcacaaatcaggtcaaggttcttacgggtacgtttttgccgggcgtattcttccacattattcgtttccgcggcaaacccaacaacgtaggggcgattgtcactgagtgcggccaccccggcgacaatgtccgggtttttgaccatttttattattaattcatcactttgcgccgcctgttttttgattttttcactggcaatagtctctgcgcgatagtcagccacggcggcgcagctaatgaaaatatgctgctgttgaacggcggcctgaacagcggcttccatgtccagcgcggttatgacatcaacccgttttacaaaaggcggcatcggtaacgaaacgggaccggagaccagcgtgacatttgcgccgcgacgcgctgcggccgccgcaatagcgaagcccattttaccggagctgtagttggaaatataacgcaccgggtcgagcggttcgcgcgtcgggcctgccgtaatcatgatattaagatgtcgcagatcgttgacggcagcgaaatgcgcggcggccttatcaacgatagctaatgggtccagcattcggcctgggcctacatcgccgcacgcctgactgccgctatccggcccccaaatgaacaggccgcgagaggcgagcacctccagattatgttgcgtggcggcagcgcggtacatctgttggttcatggccggaagaacggccaccggggctggcgtcgccaggcagatggtggagactaaatcattagccatacccgatgctacacgggcgatcagatcggcggtcgcgggggcaagaatcaccaggtcggcccatttccccaactcgatatgccccatcgcagcttcggcggcagggtcaagcagactgtcggatacgggatagcccgacacggcctgtaagctcaggggggtaataaaggcttttgccgcctcggtcattgccacgcgcacgtcagcgccgcgctcacgtaaacggcgcaccagctccggcgttttatacgcagcgataccgccgctaacgccgagaacaatttttttaccggccaggctcatcatgtctttcctgttgggtgactttgaaaggcggctattttatcacaatctctacggcgtcgtgtctttgcctgcgctccactttgcgaggcgctacgcaagaacaaaatcggggcgtcgatctctcccaaaggctgtgccactatgccgcttccttaaaaaaggaggtgcgcgtatggatacgttggacgaattattgccgcgtgaaaaaatgctcagatccggcattgcttccctcagcgacgtggaactgctggcgctttttttacgtaccggcacgccgggaaaagatgttatgacgttggcaaaagagatattgcagcactttgggtcgctgtatggcctgctgtcggcggactttgcgcagtttcgcggcgtaaacggcatcggcctggcgaaattcgcgcagttgaaaggcattgctgagctggcaaggcgctattacagcgtgcgcatgaatgaggaaagtgcgttgctgagtccggaaatgacgcgggaatttctgcaaagccaactgacgggcgaagagcgtgagatctttctggtgatcttcctagatgcccagcaccgggtgcttcagcacagccgcctgttttccggcacgcttaaccacgtagaggtgcatccgcgtgagattgttcgggaagcgattaaactcaatgcttcagcggtcattctggcgcataatcacccttcaggctgcgcagagccaagtaaagcagataaacttatcactgagcgcgtgataaagtgttgccagtttatggatatccgggtgctcgatcacctgataattgggcgcggagagtacgtttcttttgccgaacgcggctggatttaagattctttgcgcgatccatcgggatctttgtctgttcgggacttgagcatatcgccgggtcagcgtatactacgccacctttgagaatctcgggtttggcatttgggcctggcaatcgagagttcaatagaactgcgcgatgaccaggctgtaaagcctgacgaggcgccgataccccatacgaagctcgagctaatttgatttttggagaatagacatgtcccgagtctgccaagttactggcaagcgtccggtgaccggtaacaaccgttcccacgcactgaacgcgactaaacgccgtttcctgcctaacctgcactctcaccgtttctgggttgagagcgagaagcgttttgtcaccctgcgtgtatctgctaaaggtatgcgtatcatcgataaaaaaggcatcgaaacagttctgtctgaactgcgtgcccgtggcgaaaagtactaagtactaagaggaaataaatcatggctaaaggtattcgtgagaaaatcaagctggtttcttctgctggtactggtcacttctataccactacgaagaacaaacgtactaagccggaaaaactggaactgaaaaaattcgatccagttgtccgtcagcacgtgatctacaaagaagcgaaaatcaaataattctcgctttgatgtaacaaaaacctcgcttcggcggggttttttgttttctggccgtccccatattaatgagacctgccacacagccggagacgttatgcctgaattacccgaagttgaaaccagccgccggggtattgaacctcatttagttggcgctactatcctgcacgcccatatccgtaacggtcgtctgcgctggccggtttcagacgaaatttatcgtctgagcgacacacccgtccttagcgttcagcgtcgtgctaaatatctactgctggagttgcctgacggctggataattattcacctggggatgtcgggaagcttgcggatactgtcggaagcgctgccggcggaaaagcacgaccatgtcgatttggtgatgagcaatggcaaaattctacgttataccgatcctcgccgctttggcgcctggttatggaccaaagagctggaaggacataacgtactggcgcatctgggaccggagccgctaagcgatgagtttaatggcgaatatttgcaacagaaatgcgcgaagaagaagacggcgattaaaccctggctgatggataacaagctggtggtcggcgtggggaatatctacgccagcgagtcgctgtttgccgctggtattcaccctgaccgcctggcgtcgtcactctcgacagaggagtgcgacctgctggcgcgggtgattaaagccgttttgctgcgctctattgaacaaggcgggacaacgctgaaggattttctgcaaagcgatgggaagccgggctattttgcccaggagttgcaggtgtacgggcgcaaaggcgagccgtgtcgggtatgcggtacgccgatagtcgcaacgaaacacgcacagcgcgcgacgttctattgccgtcactgtcagaagtaaaatgccaggcccggcaaggaaggaaacttatttcaacttatccattagcgcctgatgcacattgtcgggcagaaagtgggtcacatcgccctgatggcgcgccacttctttgaccagcgacgatgaaataaacgaccactctttggacggcatcaggaaaacgctttccagttgcggcatcagatggcgattcatatgcgccaactgcatttcatattcaaaatccgccaccgcgcgcagaccacgaatcaggatattcgcctgtctgtcgcgggcgaaattggccatcaggtcgctaaaacccaccacctctacgttacccaggtgtgcggtcgctttttgcgccagcgccacacgttcgttcagggtgaacatgggtttcttgccggggctggcggcgatggccagaatgacatggtcgaacatctgcgttgcgcgcgtcacaatatcgagatgaccgttagtaatcggatcaaacgtgcctggataaatcgcccgtttttgcatgacagccctcaatgcgttttcggtggcagataaggttccagcagttgcagcagacgctggagcgcgccctgattttgatacagcacttcaactgcgtgacgtccgtagaaattacgataatcagcgtcggtcagtaaagaggaaacttcttttgccagcgtagccgcatcggtaatcgtgataagcccgctcgcctgctccagacgggcgcaaatatctttaaagttaaaggtatgcggacccatcagtaccggaatcgcatgagcggcggcttccagcgggttgtgaccgccgcgttcaaccagcgaaccaccaacaaaggcgagatcggcaatgccatagagcaacattaattcgcccatggtatcgcctaccacgacctgggtgctggcggacggcacttcgcccgaagagcgagtgatgtagcttaaccctgcctgacgcacaagattgatagcatccgggaaacgctccggatggcggggcaccagaatcagtaataaattcgggaattgatgtaataacgcctggtgagcggcgataacgatactctcttcgccatcgtgggtgctggtggcaatccagaccggacggtgcggcgcccactggctacgtagcgtaacggctttagccgccagttgcggtgtaactgaaatatcaaatttcagactgccggtgaccgtgacctgattgttcttcgcgcccaatgccacaaagcgttcgccatcttcttcgttttgcgcggcaatcagggtgatacggcgcaggagcgtacggacaaacttgccaagcttcgcataacccgcggcggagcgggcggaaagccgcgcattagcgataaccagcggaatatgacgtttgtgcagcgcagcaatcagatttggccagagctcagtctccatgatcaataccagcttaggatcaatcttattgaggaaacgattgagcgcatcgggcaaatcataaggtaagtaaacgtgctgaacatcgttgccaaaggcggactggacgcgctccgagccggtcggcgtcatggtcgttacggtaataggcagatcgggatagcgatgacgtagagcgcggaccaatgggatggccgccagagtttcgcccaccgagacggaatgcagcatgattccgcccggtttcaacggacggcggtagaatccgtagcgttcaccccagcgcttacgataggccggcgctttacgtccacgcacccaaagccgtatccagatcagaggctgaataaggtagagaagagcggtgtaaagcaattcgagcatagtaaatagctgacttatggatgtgctggggattctatgtatttagcctgggctttaccattacttttcccatttttgcgccaaattggctcagaagggaggattccaggcgctgaaccccattatttttgcatttttacgcaatccattgaaatttgccgcccttgtcgccccagacaatgggaatgaccattcacaagagggggataaattattatctctttgaatttataattaaaaaaatgattgtgtataaaaattattcgtatcggattgctgcgaaagaagtgttacactagcgcatctaaaatgagtgcggtattagccatcgggttgctgtgaagcctggggcggtagcgtgcttttttctgcttatttatccggacaatttcaaccaaagagtcgcttgtggaaaagccatttcgaagaattctgattataaaaatgcgttttcatggagacatgttacttaccactcctgtcatcagcacgctgaagcagaattatcccgatgcaaaaatcgatgtgcttctttaccagaacaccataccgatattgtcggaaaatccggagattaatgcactctacggcatcagtaacaaaggcgcaggaacaaaagagaagatcaaaaacgcgctatcgttaatcaaaaaattgcgtgctaactcgtatgatctggtcgtcaatctcaccgatcagtggagcgtggcgcttattgtgcgttttttaaacgcaaaaataaaaatctcgcaagatttcggtaatcgtcagtctgctttatggaaaaaaagctttacacatttagtaccttatgcgggagaacatgctgttgagcgcacattatccgcgctaaagccgttagcgctaaaacagtatgtcacggaaaccaccatgagctatcgcccggaacattgggaaaacatgcgacaacagctcaaacaacttggtgtgacccgacaatatgttgttattcagcctacggcacggcagctatttaagtgctgggataatgataaattctcgcaggttattgatgccgtgcagcgccgcggttatcaagttgtactgacgtcaggcccggccgcagacgagatggcctgcgtggatgctattgcatgcggctgtgagacaaaaccggttactggtctggcgggtaaaactcgctttcctgaattgggcgcattgattgaccatgcggatctctttatcggcgttgattcggcccccggtcatattgccgcagcagtcaaaacgccggtcatttgtctttttggcgcgacggatcatgtattctggcgtccctggaccgacgacatcattcagttttgggcaggaaattatcagccgatgcctgaacggcatgagcttgatcgtaataaaaaatacctttccgtgattccggctgaagatgttatcgccgcgacggaaaaaatgctgccgcatgaggcacgccccatagatttggacagcctgctatgagagttgccttttgcttatataaatattttccttttggcggtctgcagcgtgattttatgcatattgctcaaaccgtggcggcgcgaggtcatcaggttcgtgtttatactcagtcatgggaaggggaatgcccggataactttgaattaatccgcgtgccggttaaatcccggacgaaccacggtcgtaacgcagaatattatgcctgggtgcaacaccatttgcgcgaccatcctgtcgatcgggtggttgggttcaataagatgccaggccttgatgtgtattacgccgcagacgtgtgttacgccgaaaaagtcgcacaggaaaaaggatttttctatcgcctgacatcacgctatcggcattatgctgcttttgaacgcgccacgtttgaacacggcaagcagacgcaactattaatgctgacgaataagcagattgctgacttccaaaaacattatcagactgaagcggagcgttttcatattcttcctccggggatttacccggatagaaaatatagccaacagatcccgaacagtcgtcaaatttatcgtcagaaaaatggtatctcagaacagcaaaaattactgttgcaagtagggtctgactttacccgtaaaggtgtggatcgctctattgaagcgctggcatcgctacccgaatctttacggcaaaatacggtgctctgtgttgtcgggcaggataagccgaagaagtttgcagcactggctgaaagaagcggcgtcggcacgaatgtgcattttttctccggacgtaatgatattgcggagttaatggcggcagccgaccttttactgcatccagcctatcaggaagctgctggtattgttttgctggaagccattactgctggtttgccggtgttgacaaccgcggtgtgcggttatgcacattatattgtggatgcaaactgtggcgaagcgatgacggaacctttccgccaggatgcgctaaatgaggttttactcagagcgctgacacagccttccttacgcagcgcctgggctgaaaatgcgcggtattatgctgatacccaggatttatacagcttaccggagaaggccgcagatattatcacaggtgatttagatggttgagctgaaagcgccgttaaccacactatggcgcggtaaagatgcttttgaggaagtgaaaacgttacagggcgaagtgttcagagaactggagatgcgtcgaacattgcggtttgagctggacggcaaaagctacttcctgaagtggcataaaggcacttcgctgaaagaaattgtgaagaacctgatttcgttacgtatgcctgttctgggcgctgacagagaatggcacgccattcatcgtctacatgagctgggcgttgatacgatgcacggcgttggttttggtgaaaaaggcgtaaacccgctaaccagaacatcatttattatcaccgaagatttaacgcctaccattagccttgaagactactgtgttgactgggctgttaatccaccggacgcgcaggtgaagtggatgattattaagcgtgttgcgactatggtacgtaaaatgcacgccgggggaattaaccatcgcgactgttatatttgccactttcttctgcatttacctttcactggtcgcgaagaggatttaaaaatctccgtaatcgacctgcatcgcgcgcagatacgtcagcacgttccccttcgctggcgtgacaaagatttaattgggctttatttttcttcaatgaatattggcctgactcagcgagatatattccggtttatgcgtgagtatttctcactccccctgcgagagattttgcaaaaagactcggggttgattcatcaggcggatgttaaagccgctcgaattaaagaaagaacaataagaaaaaatctttaaattattatactgacttattatttgatttggactacatgtcatgaaagtattaattataaatgatacaggtaactcttatcattggggatgttatggaacatcgactgcgataaaagaaagtttaaggtttcgtggtattaatgaaatagtcactttctcgtgcgaagaaggtagtaagatagaaaactcacccaaaaaaattctgcttgtgtacagtaagaataagttaataaggaggttagctagccattattatagcaaacatcttcgcaggaaattacctgatttatgggattcattattaaaaagtgattgcgttataataaatggtgaaggaactattaatagtattcatacggcaacaagatttatattttttataattcacgttgcaaaagatatacttaaaaaaaggtttatctaataaatcactcttgttatcctaaattgggtaatgagaaacaaatttattattataagtgtgcttattcacgatgtaattatgttgcggcaagagaaaaaaaatcgcatgaattaattactaatatattaggcattgatgctactttatcttttgatagcttgccgttacttgtcaaaaaggttgaaagcgaaattccagaaagtttgtataaagaaaaatacgtatgtttatctggtgcggttaattataataaagaaaattcatcttttatagctggtgagattttaaagaaatataaaaatcacaaattagtttatcttgtcggctctccatctggtatgaataatgaggagccagatgtaatcgaaagcctgaagaaatttatgcctgaactaattattcatgatgcgaagtcttttactgaatggctatctgttattaagaactcagtagtactaatctcaggaaggtaccattattctattgcggcaatgtgttttggtacaccaacagtatgcttttcatctaatacaccaaaattggatgaaattaataagatgtttaatttaccaggctgtgtcagaacacatgatgaatttactaaagcgcttaacgaaattgacaatttaacatggcaaccactttctaaagagatgtctgacttagctgaatacaactataatttcctttaatttattgaggttgattaataggttattataatattaactttctaattcataagaatattatgaaaataacgtttgttggcgaagcggtatctggcttcggagggatggaaaccgttattagcaacgttatccatacgtttgaaaatagctctccgaaaatcaactgtgaaatgtttttcttttgtcgtaatgacaaaatggataaagcatggctaaaagagattaaatatgcgcaatcattctcaaatataaaattaagttttcttcgtcgatctaagcatgtttataattttagtcagtggctgaaagaaacgtcaccggatattgtgatatgtattgatgtcatctcatgcctttatgccaataaagcacgtaagaaaagtggtaaacagtttactattttctcgtggccgcatttttcgctcgaccataaaaaacatgcagaatgtataacgtacgcggattatcatctggccatcagtagtggtattaaagaacagatgatggcacgggggatctcagagcaagatattagcgtcgtttacaatcctgtctctattaaaacaatcattgtgccgccgcctgagcgcgataaacccgctgtatttctctatgtagggcgtcttaaatttgaagggcagaaaagagttaaagatttatttgatggcttagctcgtacgacaggggaatggcagctacatattattggtgatggctcagattttgaaaagtgccaggcctatagccgggagcttggtattgagcagcgtgtgatctggtatggttggcaaagcgcgccgtggcaagtcgtacagcaaaaaataaaaaatgttaccgcgttactacttacctctgcatttgagggatttcctatgactctgctggaagcaatgtcatatggaattccatgtattagttctgattgtatgtctggtccgcgcgatatgattaaacccggtttgaatggtgagctttacactccgggtgctatagatgattttgtaggacaccttaatcgagtcatttccggtgaagtaaaatatcagcatgatattattcccggcacgattgagcgattttacgatgtgctatattttaaaaattttaataatgcgatattctcgaaattacaaaagtgatcactatgagcagaaaatattttgaagaagaagtcattcaacagactttagattataactatgcacaacatagtgatgctaataaatttaatatagcttatgggattgataaaaactttctttttggctgtggtgtctctattgcatcggttctcattgctaaccgtgagaaggcgttagctttccatgtttttaccgatttctttggccctgaagatcagcagcgatttgatgcattagcaaaacagtacgctacgcagattgttgtttatctcattgactgtgagcgattaaaatcgctacccagtaccaaaaactggacctatgcaacatactttagattcattattgccgactatttttcagataaaacagatagagtgctttatctggatgcagatattgcatgtaagggaagtattcaggaacttattgatcttaatttcgctgaaaatgagattgcggcggttgttgctgaaggcgagttggagtggtggactaagcgctcggttagcctggcaacgcctgggttggtttctggctattttaatgccggttttattttaattaacatacctctttggaccgcagaaaatatctctaagaaagcgattgaaatgctaaaagatccggaggtagtacagcgcataacgcaccttgatcaggatgtattaaatatattgttagtgaataaagcgcgttttgttgataaaaaatttaatacgcaatttagtcttaactatgaattaaaagattcagttattaatccagttgatgctgagactgtatttgttcattatatcggaccaacgaagccctggcatagttggggggcttaccccgtgtcacaatattttttacgggctaagagcaactcaccatggtctcattgtgcacttttaaatccagtcactagccatcagttacgttatgcggcaaagcatatgtttaatcagaagcattatacttcgggtataaattattatatagcctactttaaacgtaaacttcttgaataaaacccataggtgatgtaatggattcatttcctgagatagagatagctgaatataaagtttttgatgaaagtaataataatgatgataacgtattaaacatttcttatggcgtcgatgaaaactatcttgatggtgtgggggtatcaatcgcttccgttgtattaaacaataatatcccgcttgcttttcatattatttgtgactcatactccccgtgttttgtaaaatatatagagcgtttagccgtacagcatcacattaaaatttctctttatcttattaaagtagaaagccttgaagtattgccccaaactaaagtatggtcgagagcaatgtattttcgtttatttgctttcgattatctcagcaagaaggtaaacaccttactttatttggatgccgatgttgtatgtaaaggatctttgcaagatcttctacagcttgatctgacagagaagattgctgcggtagtaaaagatgttgattccatccagaataaggtaaatgagagattaagcgcttttaatttacaaggtggttattttaactccggcgtggtttttgttaacctgaaattatggaaagagaatgccttaactgaaaaggcatttttacttctggcaggtaaagaagctgactcttttaaatatcccgatcaggatgttttgaatattctcctacaggataaagttatttttctacctcgaccatataataccatttatactatcaaaagtgagttgaaagataggtcacataaaaaatatagcaatataattaatgataatactattttaattcattatacgggcgctacaaaaccatggcatgcctgggcaaattatccttcagttatctattataaaaatgcacgactgaactcgccctggaaagattctcctgcaaaagatgcgcgtaccatagttgaatttaagaagcgatataaacatcttctcgtgcaggggcattattttaaaggccttctggctggaagcgcatatctttatcgtaaacttttccacaaataattcccttccctaaatctccattatgattattgaaaaaaaggttaaaaactataccgtctttgtcaaaaaagacggtgaaaaatatattgagatattcaaagattttctatcttataatcatcaggttattaaagtcttccgtaatatagaagatacaaaagttgtattgattaatacagactacggaaaatatattctcaaagtatttagtccaaaagtaaaaagtactgaacgctttttcaaatcgttagtaaaaggagattactacgaaaagctttttcatcagacagatcgcgtgcggcgtgaagggtttgcggcgcttaatgatttttacctgctggcggagattaaaacattacgctatgtaaaaacatacgtgatgataattgagtatattgaaggtattgaacttgttgatatgccagaaatttctgacgaggtgagagggaaaatcaaacagtcgatatattctctgcatcagcatggtatggtttcgggcgatccccataaaggtaactttatcctgcaaggtaatgagatcagaattatcgatttgtccggaaaaagaccttccaggcaacgaaaagcaaaggatcgtattgatttagaaagacattatggtatcaaaaataatgtgagagatattggattttacttattgatttataagaaaaaacttcgaaatttcttgcgtcgtattaagggtaaggaaaagcgctgatcaatgtagcacgtttggtttaatttaaggggctgactgacttttatttgctgcagcgttatgacatacttgagagaatttgagatgtaatattagctattgaatataacatttatttataggttgcatgataaacatacgagttttttatgggcagcgttaacttcataactcacgccgatgttctgcaacttattgcgaaaagaacggctgaagattgtattatttttctttctggccctacgtccagaaagacgccgctgtccttgttacgaatgaaagatgtcattgcagtcaatggttctgttcaatatttgctaaacaataacgtcaagccatttttgtaccttctgacggatgttcgcttcctccatcgccggcgcgaagatttttataactttagccgtaacagtcagtttactatcgtcaatcttgatgtgtacgaacaggcttcagtggatgatcaaaaatatattgaagaaaactgtttaattattcgctccttttatcgccgagaaaaagggggctttttaaagaaaattaaatttaatatcctcaagcgggttcataaagcattacttatttcagttcctctttcgaaaagaggacgactggctggattttgtaaggatatcagcatcgggtattgctcttaccatactattgcttataccgctattcaggttgcctattccctcaagtatggccgtattatatgttctgggcttgacttaacagggagttgcccacgtttctatgacgaatctaccagccctatgccatctgagcttagtaaagacctgtttaaaatactgccattttttacttttatgagaaaaaatgtgagtgatttaaatatctttaatttatcagatgatactgcaattcattacgatattattccatatattacagcctcggaacttgaagatgaaatatattacgataaaattgtctagacactagataaatcattattttgcgttgcttcggcacgcatttctttttctataatatatcttttctataaagttaactattctggattatagctattatgattaaaaaaatcatatttactgttactcctatattttcaattcctcctcgtggcgcggctgcggtagaaacctggatttaccaggttgcaaaacgattatcaataccgaatgctattgcttgtataaagaatgccggctatcctgaatataataaaataaacgataactgtgatattcattacattgggtttagtaaagtttataagcgtctttttcagaaatgggctcgtctcgacccactaccctattcccagcgcatccttaatattagagataaagtgactacccaggaagatagcgtcattgttattcataatagtatgaaactgtatcggcagatcagagagcgcaatccgaatgcaaaactggttatgcacatgcataacgcatttgaaccagaacttcctgatacggatgcaaaaattatcgtgcccagtcagtttcttaaagcgttttatgaagaaagattgcccgccgctgctgttagtattgtgcctaatggtttttgtgctgagacttataaaagaaacccacaagataatcttcgtcagcaattaaatattgcggaagatgccaccgttctcttatatgccgggagaatttcgcctgataaaggcatcctgttgcttttgcaggcgttcaaacaattacgtaccttaagaagtaatattaaacttgtcgttgttggcgacccttatgcaagccgcaagggtgaaaaagcagagtatcaaaagaaagtactggacgccgcaaaagagattggaactgattgcattatggctggagggcaatcacctgaccagatgcataacttctatcatatagccgatctggttatcgtgccatctcaggttgaagaagcattttgcatggtggctgtagaagcgatggcagcaggaaaagcggttcttgccagcaaaaaaggggggattagcgaatttgtgttagatggcataacgggctatcacctcgcagaacctatgtcgagcgacagtataattaatgatattaaccgtgcgcttgctgataaggaacgccaccagattgccgaaaaagcaaaatccctggtgttttcaaaatacagttgggaaaatgtagcgcagcgtttcgaggaacaaatgaaaagctggtttgataagtgattgagtcctgatgatggaaaacgcgctgataccgtaataagtatcagcgcgcttttttatctatttcttagcgccagcagaaaaccggtaatgataccaatttgagcaatatcgacctgttcaaaattgccacgaacgatataaaaaccgacgaaagataaaaatagcaagagatgagcattgtaggggcttatctctactttcctgaaggtagagctggctgtttccctgatgatagcgccatataaataggccaggctcgccagacccaatatgcctgcactaaaccagatgtacagaatggtattatgcggaccgatagattctttaaaggtccacgttggataatcgacaacgcgtttattataaacactatcatacacatcattaccatagccgtagcccttgatcgggttttcctgaatcagtatccacgcggtgccctgggttccgttagtataacgatatgagctatctgtctgctgtaatttataaagtaaatgttctgggtctggtttgttagtatgttgagtgataaccaaagcgccgataatggctaataaaatggcaccaactcctattaacttccattggcgattcagtattgcccatagaacacctactatgagcactgccaaccatccccctcgcgatagggttcccaggataaagaaaaggtagatagcgctaagcaccaaaaaaaccaacttaattgaattttttctaaacaaccaaatattcaataatgctggaaataagaaaaccatggaatcggacatatgtcgatgcgcatagcttatgaatggcataatccctttattatagtcctcgatatacagaatactctctgcaaggcagcgaagtcctaaacttgttaaaaaggagaaaagtactattttcgcaatcgtttcttttgtttcatcttttaatagtacgggaattaataaagtatataataagaaaccctccagtaccgtattttcaaattctttgaaactttctttcatatctggcgatatgagtatggaataaacaaggattaatgataatactgctgcgctataaaatacgctatttttgaaaagaggggggaaacttttcggtgagcgtgagacctgataaatcgcggtgataaccataagtatgattatcaaatgtttataacgcgtaataccatccagaaaatacgtggcaacaaaaagaaaaaccagcgctttattccagatcggcttccatttctctttatttaacgttaatgatgtggttagcatcttttctccacaataggtttgggatgagacagagtctctttaatgaatctttccaaatacgcttgtggcatctaaattcgccaggttttgttctggtgagcagcatgccatttggttcttcccataacctccaattaacccagggtccgttgggccatatagcgtaatattcggtctgtcgagcgcggcggtgagatggctcaggccggtatcaaccgatacgacaaattttgcgccagccagcactctagcgacctcctccaggctcatgcgcggtaacacatccacatagtcaaagccttcggccagtcgtttagcacgagcctcctcatgaggcgcgccccagggaagttttatccgtaatccggtgttgcccaccaggccgataagctcgcgccagtttgcttccggccagtgtttatcatcgcgggtcgtggcatgtaaaaacaccgcatacggatcgctaaccgcctgctggcaatgcagaaaatgttttgcgatggcataatcgccctgcgactgcggtttatcgtatcccaggcttttggcgaacagctcgcgcgtccgttcaaccgcatgttgttgctttgcgatatggtgtttacggttataaaacaggctggccagcggttcgcgggcggtactccagtccataccgtgctttatcccatgcgccagacgcgtcaccagcgccgcgctttttaccagcccctgcgcatcaatcacagcgtcgtattggtatgcgcataccgcccgatgaaaggctatgcgttccgctttaatgggcgcggaaaaccaggccttgcgccaacggcgaatagcgacgggaatcacgcgatcgacagcactgtgccaggacggaatttgtgcaaacccttcttcgacaacccaatcaaattgaatccccggaatcgcctgttgcgcgtcggtaagcgcaggcagggtatgtaatacgtcgcccatcgatgatgttttaacgatcaaaactcgcattaaacgccctcttccgacaacagcgaatgaagctcttccagaacccgctgcggcgtgatatcgatcaggctctggtgatagccttgcgccgtatcgcctttacgcactttgtggtaacccgtaatgagacgaatcacccgggccttatgagacagcggcggcgtgaaatccgggctacttgggccatacaacgcgaccagcgggcggtcgagcgccgccgcgacgtgcatcagcccggaatcgttagtgacgatggctttacaggcggctatcagaatgacggcctgttccagctgggtttcccctgccaggttgcgacaccatgcctgttgctcgctattcagcgccgccaggatctcatttccggcttcatggtcttttgccgagccaaacagcacgacctgatacccttcgttaatgagctgctttgccagttcggcgtagtgatagtgcggccaacgttttgccgggccaaattctgctccggggcaaaagccgattagaggacgttcagaagatagcgaaaaatcgctgtacatcagcgatttttcaccctcgctaacctggagctgtggccagagcagcggctgcggcagatctttcgccgtgcgcatcacgcccttgtcataggccagcgccacgtagcgctccaccatcagcggccaggcgtctttatcaaggacgcgcgcatcgttcagcaggccatagcgcatttcgccacgccagccggtacggtgcgggatattggcaaagaaaggaatcagcgccgatttaaacgaatttggcagcacccaggcgcgatcgtagcgcctctctcgcaggctatggcccaatctgcggcgctcgccgatttccagcgcgccgtggcccagcggcatgggtatcgcctcgttaacttccggcatacgcgataacaacggacggcaccaggctggcgccatcacgtcgattatcgcctggggatagcgcgctttaagcgtgcgatagagactttgcgacatcatcatgtcgcccacccaggacgggccaatgaccaaaattttcatacttacgcgtcgcggttcagccaggccatatactccgtgacgccttcggcgacggtcttaaagggtttgtcgtagcccgcgttgcgcagattggttaaatccgcctgcgtaaacgcctgatagcgacctttcagcttatccgggaacggaatgtattcaatgctgccttttttatggtatgccagcgtcgcgtcggcgacggcctggaaagattccgcgcggcctgtgcccaggttaaagatgccggacttgccgctttccaggaaccacaggttaacggcggccacatcgcccacgtaaacgaagtcgcgcttgaagttttcgctgccttcaaacagtttcggactttcgccgttgtttaactgtgtattcagatgaaatgccacgcttgccatgctgcctttatggccttcacgtggtccatagacgttgaaatagcggaaaccgacaatctgcgagttcgcttctggcaggatctggcgcacgtattcatcaaacaggaatttagaatagccgtaaacgttaagcggtttttcgtattcacgcgattcgatgaaatcagacgtgcgaccgccataggtggcggcagaagaggcgtagaggaacgggatttcgcgctcaagacaatagtgcagcagctctttggagtattgatagttattatccatcatatacttgccgtcccactcggtggtggaagagcaggcgccttcatggaaaatagcttcgatatcgccgagctcttctccggacataatctggatcaggaaatcttccttatccatatagtcagcaatgttcagatccaccaggtttacaaacttggtgccgtctttcaggttatccaccaccagaatatcggtgatacctttatcattcagggccttaacgatattgctgccgataaagcccgcgccgccggtaacgatgatcataactgtaacctttgaattatggtgtcagagactgtctcagacatgaatgcttttatcatatcactattcatccattcactgataactcgtgaggatacgcgtgatttatgctgcattttaaagaagtgatgacgcgtcatctcgtatcaccgtatagctttgggtaatatgtgctgaaatttgcccagtctggagaatcgcaatgcgtggggatttttacaaacagttaaccaacgatctggaaaccgcccgggcggaaggattgtttaaagaagagcgcattattacgtctgcgcagcaggcggatatcaccgtggcggatggaagccacgttattaacttttgcgccaataactatctcgggctggcgaatcaccctgagctgattaatgccgcaaaagcgggcatggacagccacggtttcggtatggcgtccgtgcgttttatctgcggcacccaggacagccacaaagcgctggagcaaaagctggcaagcttcctcggcatggaagatgcgattctgtattcctcctgtttcgacgctaacggcggcttgtttgagacgttgctgggcgcggaagacgctattatttccgacgcgctgaaccacgcgtctatcattgacggcgtgcgtttgtgtaaagcgaagcgctatcgctatgccaacaacgatatggtagagctggaagctcggctgaaagaggcgcgtgaagccggcgcgcgtcatgtcctgatcgccaccgacggggtgttctcaatggatggcgtcatcgccaatctgaaaggcgtctgtgatctggccgataaatacgatgcgctggtgatggttgatgattctcacgcggtaggctttgtcggcgaaaacggtcgcggttcccatgaatactgcgacgtaatgggccgcgtagatattattaccggtacgctgggcaaagcgttaggcggcgcatccggcggctataccgcggcgcgtaaagaggtcgttgagtggttgcgtcagcgttcccgcccatatctgttctccaactccctggcgccggcaatcgtggcggcttctattaaagtgttggagatggtggaagcgggcgcagaactgcgcgatcgcttgtgggcgaacgcccggcagttccgtgagcagatgtctgccgcgggatttacgctggcaggcgcggatcacgccatcatcccggtaatgctgggagatgcggttgtcgcgcagaaatttgcccgcgaactgcaaaaagagggcatttacgttaccggtttcttctatccggtcgtaccaaaaggtcaggcgcgtattcgtacccagatgtctgcggcgcatacgcctgagcaaattacgcgtgcggtagacgcgttcacgcgtattggtaaacaactgggcgtgattgcctgaggatgtaagatgaaagcgttatccaaactgaaagcggaagagggcatctggatgaccgacgttccggaaccggaagtcggccataacgatttgctgattaaaatccgtaaaacagccatctgcggcactgacgttcacatctataactgggatgaatggtcgcaaaaaaccatcccggttccgatggtcgtggggcatgaatatgtcggcgaagtggtcggcatcggtcaggaagtgaaaggctttaaaatcggcgatcgcgtctccggcgaaggtcacatcacttgcggtcattgccgcaactgccgtggcggtcgtactcacctgtgtcgcaacaccaccggcgtgggcgtcaaccgtcccggctgcttcgcggaatacctggtcatcccggcattcaatgcgtttaaaatcccggataacatttctgatgatttagcctctattttcgacccgtttggtaatgcggtgcatacggcgctgtctttcgatctggtcggcgaagatgtactggtatcgggggcggggccaatcggcgtaatggccgccgcggtggcgaaacatgtcggcgcgcgtcatgtggtgattactgacgtcaatgaataccgtctggagctggcgcgcaaaatgggcgtcacccgcgcggtcaacgtcgcgaaagagagcctgaacgacgtcatggcggagctgggaatgaccgaagggtttgatgtgggtctggagatgtccggcgcgccgccggcgtttcgtaccatgctggacaccatgaatcacggcggtcgtattgcgatgctggggattccgccatcagatatgtctatcgactggacaaaagtcatctttaaaggcttgttcattaaaggtatttatggtcgtgagatgttcgaaacgtggtacaaaatggcggcgctgatccagtccggtctggatctgtcaccgattatcacccatcgtttctctgttgatgattttcagaaaggttttgacgccatgtgttcaggccagtcaggaaaagtcattctgagctgggattaatatgtatatacccaaaataattcgagttgcttaaaggcggcaagggagtgagtccccaggagcatagataacgatgtgactggggtgaacgacaaatctgccgggagcagatttgaacgtcgcgtgcgacggcccgtcagggcgaggcccatagatgggccgagtaatccgtagccaacacataagcaacttgaagtatgaagggtatagagacccaatgatatttatcgggtctgatatacgtttcatcgtaaaaggttggtgtcattcgccaaccttttttgttagggaaaatctggaaagctgtaaagaattgtcatagacatcaagcattcgtaattgcgctttaatcttattttactcgctaacgtcacgccctactctgagttttgtgcttgctttttactgtaaaaattaattatggcggcttaatagtttcttaatagagccacagtataaaggcagggtaaattaaggtttttctggtaatcgttatgaaaaatagtaaaaccaaagtgagtatcattatcccgttatataatgcgggagcggattttaatgcttgcatggcgtcgttaatcgcgcaaacgtggtcggcgctggaaattattattgtgaatgatggatcgacagatcattccattgagatagcaaaacattacgcggaacattacccgcacgttcgactgcttcatcaggccaatgctggcgcatctgtcgcccgtaatcttggtttgcaagcggcgaccggagattatgtcgcctttgtcgatgcggatgacctggtctacccgaagatgtatgaaacgctgatgactatggcgcttaacgatgatctggacgttgcgcagtgtaatgcggactggtgcgtccgaaaaaccgggcacgcctggcaatctattccgaccgatcgtctgcgttccaccggggtattaagcggaccggattggttgcgtatggcattggcctcgcgacgctggacgcatgttgtctggatgggcgtttatcgacgtgcgttaattaccgataacaatattactttcgttcccggactacatcatcaggacatattatggtcgacggaagttatgtttaatgccacgcgcgtacgttataccgaacaatcattatataaatatttcctgcatgataattcggtaagccgtttgcaaagacaaggcaataaaaatcttaattatcagcggcattatattaaaattacgcggttattagaaaagctcaatcgtgattatgcccggcgtattccgatttacccggagtttcgccagcaaattacctgggaagcgttacgcgtttgtcatgcggtgcgtaaagaacctgatattttgacccgccagcgtatgattgccgaaatttttacttctggcatgtatagacggatgatggctaacgtccgcagcgcgaaagcggcttatcagacgctgctctggtccttccggctgtggcaatggcgcgacaaaaccttgtcgcaccgtcgtatggcccgtaaggcgctcaatctgtcttagcgctcatgtttttaggcgcggcgattttcccccagccttgccactggtgctgaaaccagacaatcacggaactttgcgtaatgctctcgccgatgacgctgaaaaagcgcgtagcgtagactggttgcagcggttttttcggcttgcacatcttcacgccgcgaaagggattgcgcggcgcgtcaattttctgcggcgtcaaatcaggtcgagacgtatctacctgcggttcgttgagcaggctgcctggacgtaccagggtgatatctgccggcaggcgataaaccatctgttgcagcacgcgaaccgttgcgggatgcggatgaccaatcgcgatagcggaaccgttgcgacgggccagttcgatagtgcgattaaactgacgacggatatccgcctcgttttgcgtatcgtcgaggaacactttgcgcttgatcactttcacacccgtaccggatgccgcgcgcatcgcctggctattgccaatcgtcatgctgtcgagaaaatagagattgtaatgttccagcgcctgcataactttttgcataccgaacaggctggaagtcattgcgctgcccatgtggttattaagcccaacggcatacggcacgttgtttaccgcctcgcggataatgcgctcgatctcatcgctgctcatatctggtcgcagcgtatccttctccagcggctgtttgcttagcggcgccatcggcagatggattaacacctcatgcccgctattgtgcgctttagtcgccatttcgcgcgcgtgcggcgcgttgggcagtacagcgacggagatgtttggcggcagcgccagaacctggttttccgtgtgcgggcgatagccaaaatcatcaatcacgatggcgagcttgccagcgaaaacgggatgtgcaaatgccagcaaagtggccagcgtgagaatggagcgacgaaactgaggcaaaacttatcttcccaaccacggctgtggattgacggcctgaccctggcgacgaatttcgaaataaagcgaaggtctgccctgaccgccgctactgcccacaagggcgataggttgtccggcgcgcacctgcgcgcctacgctgaccagcgcgctctggttatagccgtaaaggctcatatcacctttaccatgctccacgaccaccaccaggccatagccttgcagccagtccgccagaatcaccctgccgtcggcgatggctttgacctcggtgccttccgacgcgccgatcaccatccccttccaacgtagctcaccctgcagccgttcgccataacgatgcaatatcgggccacgtaccggccagtatgcctgaccgcgaggcgcgcccagaccgccggtgcgggacattagcgagcgctcgctttccgtcggcttataggtgctgcctttacgcgaggcttcctgctgcttatcgcgtaccgcctgcgcttcgcgggcttcacgctccgctcgcgctttggccgccgcttccgcccgcgcgatactgttgcgtaggcgtgattcgttggcgcgtagttcgcttaactgttgctggccttgctgaatagacgactccagtccggcaagcgttttcttacgttcattacgcgcctgttccagcttcgcctgctgagcgcgctgttcatacagcaacgtttgttgttggctttgcttctcttccagctcggctttttgcgtggcgacctgttcgcgagtctgtttcagttcggcgatagtctcctggcgcgcctggttcagatagccgaagtaggcctgcaggcgttgcccacgctggctctcttctccgctaagaataagctgaatgccggtgtgttcgccctggcggaaagcggcgtccaactgcgcagcgagattacgctcctggctggctttttgctgctccagtttggcaattgaggcgttcatctcatcaatttgcgcgtttaactgatccagagtgctttgcgtttcgcgcagcttacgcgctgcggccgagatggcctcttcctgggttttcagttgtgccaagaggctggcgcgctgttgctgctgctggcgtacgtcgcgttctttcgcggcgatatcggcctgaatagatttgagttgatcacggtcatccgcgtgggcggaaaaggcgcacaacaatacgccagcgctaagtacgctggcgtagaacaaaggcctgactgaaaacgttcttggtttcacggcctgttgaatggtgttaatcgcctttcccctcatggggagggattattccacgatgaacagcggcttaccagtcatctcttgcgggatttccatccccatcagcgacagcatggtaggcgcaatgtctgaaagtttgccgccttcgaccgccttcacgtttttctcgccgacataaatcagcggcaccggcaggttggtgtgggcggtatgctcctgaccggtcgccggatcgcgcatctgctccgcgttgccgtggtccgcggtaatcaacagttgtccaccaacggactcaaccgcttttgttacctgttcaatgcagttatccaacgcttccaccgctttgatggcggcttccatcacgccggtatgaccgaccatatcgccgtttggatagttacaaatgatggtgtcgtacttaccgctttcgatcgccgcgaccaatttttcagtcaattctgcagagctcatttccggttgcaggtcataagtggccactttcggtgagttgatcagaatacgctcttcaccagcaaacggttcttctacgccgccgttaaagaaaaaggttacgtgcgcatatttttccgtttcggaaatacgcagctgagttttgtcgtttttcgccatccattcgccaaaggtattcgccagcgacgctggtgggtaggcaacggcagttttgatatcggcggcgtattcggtcagcatcacgaagttcagattaaccactttcttacgcgcaaagccgtcgaaatcagcattaacgaaagcgcgggtaatttcgcgcgcgcggtcagcgcggaagttcatgaaaatcagcgtgtcgccgtcttccatcgccgcatcagcctggccctcggcgcggataacggtcgctttgacaaactcatcgttttcatcacgagcgtaagcggcctgcaggccagccacagcggtatccgcctggaattcgccctgggccagggtcatcagatcatacgctttttccacgcgatcccaacggttgtcgcggtccatagcgtagtaacgaccgacgatagacgccacgcgacctttgcccagcgcggcgaatttgtcttcgaattttttcagcgaggcttcagcgctgcgcggcggcgtgtcgcgaccgtcgaggaaggcgtgcagatagattttttctgcgccgcgctctgcggccagctccaccatcgccataatgtgatcttcgtggctgtggacgccgcccgcggacagcagacccataatatgaaccgctttaccggcgtttttcgcctggtctaccgcattggtcaggactgggttagcaaagaaagtacgttctttaatttcaacgtccagacgcgtcaggtcctgataaacgatgcggcctgcgcccaggttaacgtggcccacttcggagttgcccatctggcggtcaggcagacccacttccagaccggatgcgtcgatcagggtatgcggacgttttgcccacagagcatccatcaccggggttttggcgtttaagatagcgttatcctgctgttcttcacggtagccgtagccatccagaatcaccagtaccataggttttttagaaaccgacattgcgacaacctcatactcaatagacaaaataattgcgtaattttactacagctgaatcgataaaatagcctcagaagatcaaagaaagggatcgcgctggcgtgagaaggcaagtaatagcgtgattttttttcgtagcgccccgcaaaaatgcattccagtgcacgctctggctgtatttgcgccactgcgcaggtatactcctttcctggttttttaatcactacgtcgggagttgttaccccccatgcaagaaattatgcaatttgttggccgtcatcccatactgagtatcgcctggattgcgttactggtggcggttttatttaccacgttcaaaggtctgacttcaaaagttaaggtgattacacgcggcgaagccacgcgccttatcaacaaagaggacgccgttgttgtggatttacgtcaacgtgacgatttccgtaaaggccatatcgctggcgcgaccaatttgctgccgagcgaaatcaaagccaacaatgttggcgaactggaaaagcacaaagacaagccaattatcgtggtcgacggttctggtatgcagtgccaggaatccgctaacgcgctgacaaaagccggctttgaaaaggtctttgtgttgaaagaaggcgtagcaggctggagcggcgagaatctgcctctggtgcgcggtaagtgattacccgtcgttttcatgacgcaaggggaatgacttgcccttgcgtcgacatgaaatccatcgggtaaaaaacaggagcgaagtcatggccaatattgaaatctacaccaaagcaacctgcccgttttgccatcgtgcaaaggcgctgttaaacagcaagggcgtgagtttccaggaaattgcgattgacggcgacgccgtgaagcgtgaagagatgatcaaacgtagtggccgaacgacggttccgcaaatttttattgatgcacagcacattggcggttgtgacgacttgtatgcgctggatgcgcgtggtggactggatccgctgttgcgttaaggcgtactcaagtatttaaggacaacactaaagggttttacacatgtcagaacaaaataacactgaaatggctttccagatccaacgtatctataccaaggatgtttctttcgaagcgccaaacgcaccgcatgttttccagaaagattggcagccagaggttaaactagatcttgatacggcatcttcccaactggcggatgacgtttatgaagttgtgctgcgtgttaccgtaacggcttccctgggggaagaaaccgcgttcctgtgcgaagttcagcaggccggtattttctccatcagcggtattgaaggcactcagatggcgcattgcctgggagcatactgcccgaacattctgttcccgtatgctcgcgagtgcatcaccagtctggtttcacgcggtacgttcccgcaactgaaccttgcgccggtcaactttgatgcgctgttcatgaactatttgcagcagcaggctggcgaaggtactgaagaacatcaggatgcctgatgaaccaaagtaatgcgtcaatgacagtcatcggtgccggctcgtacggcaccgctctcgccatcactctggcgagaaacggccaccaggttgtcctgtggggccacgacccaaaacatatcgcgaccctggagcacgatcgctgcaacgtcgcgttccttcccgatgtgccttttcccgatacgttacacctggaaagcgacttagcaaccgcgctggcggccagtcgtaacattctggtggtggtgccaagccatgttttcagcgacgtgctgcggcagattaaaccgctgatgcgtccggatgcgcgtctggtatgggcgaccaaaggcctggaagcggaaacggggcgcctgttgcaggatgtcgctcgcgaggcgttaggcgatcaaatcccgctggcggtgatttccggtccgacgttcgctaaagagctggcggcgggtttgccgacggcaatctcgctagcctcaaccgatgagacctttgccgacgatctccagcaactgttgcactgcggaaaaagttttcgcgtctatatcaatgcggattttatcggcgtgcagcttggcggcgcggtgaaaaacgtgattgcgattggcgcggggatgtctgacggcatcggcttcggcgcgaacgcccgcacggcgctaatcacgcgtggactgaccgaaatgtcgcggcttggcgcagcgcttggtgccgatcccgccacctttatggggatggcgggtttaggcgatctggtgctgacctgtaccgacaaccagtcgcgcaaccgtcgttttggcatgatgcttggccagggcatggacgttaaaggcgcgcaggataagattggccaggtggtcgaaggctatcgcaatacgaaagaagttcgtgaattggcgcaccgttttggtgttgaaatgccaataaccgaggaaatttatcaagtattgtattgcggaaaaaacgcgcgcgaggcagcattaacgttattaggtcgcgcccgcaaggaagagctgagtcgccactagccgtaaggaactgtttgcataaacgacccaacccgcacagaacgggttggtcgttttctgcccgtctggagtaagccatgccgtgtgaagaactggaaatcgtctggaagaatattaaagctgaagcccgcgctttagctgactgtgagcctatgttggccagtttttatcacgccacgctactcaagcatgaaaatctgggcagtgcgctgagctatatgctggcaaataaactggcttcgcccatcatgcccgctatcgctatccgtgaagtagttgaagaagcctatgccgccgacccggaaatgatcgcgtcggcagcctgcgatattcaggccgtgcgcactcgcgatccggcggtggataaatactccacgccgctgttatatctgaaaggctttcatgcgctacaggcctaccgcattggtcactggttgtggaataaaggtcgccgcgcgctggctatcttcctgcaaaatcaggtttcggtctcgtttcaggtggatattcacccggcagcgaaaattggccgcgggattatgctcgaccatgccaccggtattgtggtgggggagacggcggttattgaggatgatgtgtcgatcctgcaatccgtcaccctgggcggtaccgggaaaacgagcggcgatcgccatcctaaaatccgcgaaggcgtgatgattggcgcgggcgcgaaaattctcggcaatatcgaggtggggcgcggcgcgaaaattggcgcaggctccgtcgttttacagcctgtcccgccgcacactaccgccgcaggcgttccggcgcgtattgtcggcaagccgggcagcgataagccgtcgatggatatggaccagcatttcaacgggctacaccatacgtttgagtatggcgacggcatctgaattgcgcggtacaactaaaaaacgctgttccgatggagtgcaatcccggaacagcggagcgaagaattcgcaatgtggacaatcaggctgcggatgatgtcagcgtgatgcgatccagcgggccgacgataaacagatatgaaatgagaccaataagtcccatcgagccaacgtataaaatggcaaagtcgaacgactgagtattggcaagaatcacgccgatgaccagtggcgtaacgatgcttgccatattgccgcacatgttaaatacgccgccagcaatacccagaacttccttcggcgaggtgtcgctgagtacgcaccagcccaggttaccaaaccctttggcaaaaaaggccagactcatcgccgcaatgaccacaaattctgaagaggtgtagttggcgatcacaattacgcaagagagcaacataccgcagataacaggcagtttccgcgcgacggtaaggctatagccgcgtttgagtagccagtcggagaacacgccgccgagcaggccgccaataaaaccggcaatggctggaatactggccacaaaaccgactttcagaatcgacatgcctttcgcctggtacagataggtcgggaaccaggtcaggaagaaccaggtgatagaggtgacgcagaattgcccgatgtaaacaccgatcatcatccggttaacacagacggttttaatctgcgcgaacgttattttctgcggctcctttttacagcccagagagggctcgccaccaccgctacgaatatagtcaatttccgcttgattaacttttgagtggtgcatcggatctttgactttcattaaccagaatataccgaacatcacaccaatggcgccaatataatagaagacaaaatgccagcttaaattatgcagaatgatcgtcattagcggggtgataatgcccagcgagatatattgcgcagcctgataaactgaagtaacgaaacctcgttcattattgggaaactattgtacgcttaaacgactgttcgccggaaaggcaggcgcttcaatcgcgcccatcagcagacgtagagtaaccagtacaattaatgggctgccatacagatagatcgttccctgaaacatggttactaacgaccagccaatcaatgcgcaaccgtaaaccagtcgtgaaccgtagcggtctaatagccaaccgccgggtagttgcataatgacataggcaataccaaatgaggagaaggccaggcccatcgcttccggatcaaaacctaattctttactcattattggggcaactacggatagagttgcgcgatccgcataattaaatacggtagcaagaaataaaaatataagaatggtatgacgcacttttgtgcactttattattgtgttcattatctactcctcagataagggcagaatgcatcctgtaaggtaagagaggcgggacggattcccgccagtcgggttaagggcgtttgccaaattcacatgttaattgtgtccagcggcgcgcttgttcactgagcgtgaaacccagaccatgacgatcggaaatccacatgcggccatcgcgcagctcaagttgctcgttgaataatgggttcagccactcgaaatgttccagccacggctccaggggatacgctgcggaaaggtgcaggtgtacttccatcgcaaagtgcggcgccagcttacgcccgtgtttcgccgccagatccataatcttcaggaacggagagataccgccgacacgcggcgcatctggctgaacgaaatcgctggcattgcccagaatcaactgctcgtgttcccggaaactggtcagcatttccccggtggcgataggcgtatccagcgcggcagcaagctgggcgtggccttcgatgtcgtaagcatctaatggttcttcaatccagataagattgaactgttccattttacgccccatgcggatagccgtttcgcgatcccactgctggttagcgtcaaccattaacgggaactcatccccaagcgcttcacgtactgcggttaagcggcgaatatcctcagcgcagttgggttgtccgactttcaacttaataccgccaatgccattttcgcgggaaatcaccacatttttcagcacttgatcgagcggtgtatgcaagaacccccctgaggtgttgtaacactgaacggagtcgcggtgcgcgcccaacagttttgccagtggcagaccggcacgtttagccttcatatcccataaggcgatatcgataggggagatagcctgtaccgccatcccgctacgccccaccgaggctccggcccacagcagcttggtgtatattttgtcgatatcattggggtcttcgcccagtagattgtcggctatctctttggcgtgagcataaatactctggccgccagcacgtttggagtagctaaaaccaacgccctcaaagccatcgcgactgcggatttcggcaatgatgattgccacttcggtcaaaggtttctggcgaccggtcagtaccttcgcgtcactcactggcgtcgccagcggtagaaaagccagtgatagcttcacccattcgatacgatcgccggtttctgccgcggttctggtattcgccgcttttgcatacgttacggcgtcggaattcgcgcttaaagccattttttttctcctgataaacacaaaatgattgcgctaacatttttattattaagcgaacgcaggatccagaaagttgatgttgatttgaacatttgatcacatatgtcgtataaaaagcaggatttattgcaaaatggatcacgatccaaaaatatctggggaaatgcataatacaaaatgatgtcgctatcattttgtaatgactgagcttgataagctactgtatttacggcctttcctgatgcgaagctggcaatagccgcaggcatgatgaataatgcgcggataaatcagccaatctttgcaggggcatcagacgtgaagagaaccaaatcacctcgtgcgccgacgctggaagatgtagcacgtagcgccgggctgtctccgatgacagtcagccgggcattgaattcgccacaactggttcgccccaaaacggttgagaaagtcatgcaggcggttcgcgtcacaggctacatacccaacgcgttagccggtggtctggcgtcgcgacggagtaaattaatcgctgtcgtcgtgccgcaaattaacaacaacatgtttgtcgataccatccagtcactgagcgatgaactggcccgacgcggatatcacatattgctgtgcgtggcgggatataccgaacaaacggaagcggagttggtggcgacactgctttcccgccgccccgatggcgtggtgcttaccgggatccatcacacgatagaactgaaaaaggtcatcctgaacgcggctattccggtggtggaaatttgggacttaacgcccacgccgcttgatatgctggtcggtttttcccatgaaaaagtcgggcaggcgacgggggagtatcttctgagtaagggctatcgtcgtcccggcttgttgtggaccgccgatcgccgagccgcgcaacgtaagcaggggttatgtagtgttcttcaacgccacgctattcatgccgtaccgcaggtggatgtcccccttccggcatcgctttcgctggggcgtagcggtttaagccagctttttgacgaagggacgtttgatgtcattgtttgcagttctgataccctggcacagggggcgatgatggaggcggaaagccgtggtttgcgcatcccgcatgatttagcggttattggttttggcgaccttgattttgccgccagcaatcgaccgtcaattactaccgtaagcgttgacagacgcgccattggtcagcgcgccgctacgctgttggccgatcgtattgaacagaaaccgtgcgcagaagctattgtggatattggctttcatttgattgagcgagagtccgcataaacgggaacatgccatcgggatcggccaggccggatcaggcgttagccgccatccggcattgaatatattacgaccgcaataccgcgccggggtatcctaactggcgccacgcttcatacaccaccaccgacaccgcattcgacaggttcatgctacggctatccggcatcatcggaatgcgaatcttctgctctttaggcaacgcatcgagaatgctggcgggcaggccgcgcgtttccgggccaaacatcaaataatcgccatcctgatagcttacggcgctatgggcgggcgtgccctttgtcgtcaacgcaaacaggcgctgtggattttcggcggcgacaaaggcggcataatcgtgatggcgctgaaccgcggcgaattcgtgatagtccaaccctgcgcggcgtaagcgcttatcatcccaggcaaaccccatcggttcgatgatgtgcagacgaaagccggtattggcgcaaagacgaatgatgttgccggtattcggcgggatttctggttcgaagagtacgatgttaagcatgatgcccccttaaatgcggggggcagaatagcagaaatttaccgggctctcacgcgccagacgttcaggcggcatcgcctttgctcattggcgccagcgcggcgggcaaacttttccccagttcctgcaccagtgaatcgccactgatttcgctaatggatttcgcgccggtcagggtcatggcgactttcatctctttctcgatcaggtccagtaggttagcgacgccagtttttcctgccgtcgccagcgcgtagagataggcccgacccagcagtacggtatcggcccccagcgcaatcatacgcacgacatccagcccgttacgaatcccgctatccgccagaatggcgatatcgcctttcaccgcatcggcaatggcgggcagggcgcgggcggaagagagcacgccatcgagctggcggccgccgtgattcgacaccacgataccgtcagcgccgaaacgtaccgcatcgcgggcatcttctggatcgaggatccctttgatcaccattgggccgtcccagaattcgcgtatccactccagatctttccaggagatggacggatcgaagttatttgccagccagccgatatagtcctcaaggccggtcggtttacccagataggcggaaatattgcctaaatcatgcgggcgaccgttcaggccgacatcccacgcccatttagggtgcatcaccgcctgccagtaacggcgcatggccgcgtttgggccgctcatcccggagtgggcgtcacggtagcgcgcgcccggcgtcggcatatccacggtaaagaccagcgtggagcagcccgccgcttttgctcgttccagcgcattacgcataaagccccggtcacgcagtacataaagctggaaccacatcgggcgtttaagcgtgggggctacttcttcaatcggacagacggagacggtggaaagggtgaacggaatgccctttgcgtctgcggcggcggcggcctgtacttcgccgcgacgggcgtacatgccgcacagacctaccggcgctaatgccaccggcatcgacaacgtttcgttaaacagggtcgtttccaggcttaaatcggacatatttttcagcacgcgctggcgcagagcgacttgcgacaggtcttccacatttcggcgcagggtatattccgcatacgcgccgccgtcgatgtagtggaagaggaaaggaggcaacgtgcgctgagctgcggcgcgataatcgctggttgctgaaataatcatgatttattctccctggtcatctcattatggtcgccgggcaggcgggtaatgcgcgcctggcgggcctggtcttcatcaaatcgtttaatcgtggtgtggacaaaactgaggtgcgccatcatcgctttacgcgcgccctcggcgttaccgtccagaatggcgtccaacaccgcctggtgttgttccgtcagctttgagaatacgggcggaacgagatacatacgctggcgactctgtttgacggaggattgcaggacgtcgaagaaaccgcgcatggtttgcaacagcaccacattatgcgaggcttccgcgatcgccagatgaaagcgcacgtcggcctgggaggcgagatccgggtcttcgctgagcgtcgcatcaaagcagagtctgattttctctttgtcggcggcggtggcacgcatggcggcgtgccaggccgtactggcttcaatggcgtggcgggcttccagaatgtcgaaactgtagtccggatcgttcgccatcagcattttcagcggttgcacgatattctgttcagaccaggtttcgtgctgccagcggacaaatgtcccgccgccgcgacggctcaccagcacgccttcgctgaccagcttcgccagcgcttcgcgtaaagagttgcgtgatacgccaagctgtagagccaactggcgctcggcgggcaatttcatgcccgcttccaggttttgttcttcaatcagcgcccgcacgcgagaggcaatctcgtctgacaggcgttttggcatcacaatcacggaatcatccaggttaaaacataggcctgaagcgtagtgatcacgcccaccatacaggtgaagatcaggctgtgtttgacggtaaaacggaacagatcggactctttccctaccagtcccaccgccgcgcaggcgatggcgatagactgcggcgagatcatcttcccggttacgcctccagtggtgttcgccgccaccatcagtacatcagagacgccgatttgctgcgccgcggtagcctgtagagaggcaaacagcgcgttagatgaggtatccgagccggtcaggaagacgcccagccagccgaggaacggcgagaagaacgtgaaggcgctgccggtgtgcgccagcgctaacgccagcgtggaggaaagcccggaatagttcgagataaacgcgaacgccagcaccatgccgatggagtaaatcggcaacgccagctctttcagcgtgctgccaaaggtctggattgcggctgagggtttcattttcagccagacaatagacaacagcgcggcaaacaggatcgcagtgccggtggcggagaaccagtcaaatttatacaccgccgcgtaagcggtcgcttcgtgtacgaccggcggcatacgggcgaccagtttatcgagatacggtaccggaacgttaattacccagtcatacagcgcgccgccgggggcaaacagcgctttgaacggcggtatgctccagagcgtgaccgtggcggtcaggaacaggaacggcgaccaggcgcgaacaatttgtcctgtcgtataacgggtgcgggccagcgtctgatcgacctgcgacgcgcccatatcgccgaagcggaagatgcgtaccggctgccagcgtttgaggaacagcgtcagacacaccagagacaccagtgaagagatgatgtccggcagttccggcccgataaagttggagctgagatactgggcgatagcaaacgagccgccagcgaccatcaccgcaggccaggtttctttcacgccgcgccagccgtccataatcgccataatccagaacagcacgataatggtcaggaacggcaactggcggcctaccatctgaccgatttcaaagctgtccaggtccgtgacctgtccggcaaccagaatcggaatacccatcgcgccaaaggcgaccggcgcggtgtttacaatcaggcacagccctgccgcatacagagggttaaagcccaggcccaccagcagcgcagcggttatcgccaccggcgcgccgaaacccgccgcgccttcaaggaacgcgccgaagcagaagccgacaatcagcatttgcagacgctggtcgggggtaatcgacagaattgacgagcgaataatgtcaaactgcccggtcttgaccgaaattttatagacaaagaccgcggcgatgattatccaggctatcggccatagcccgtagaagaagccatacacgaccgatgccagcgcgtgatcgaccggcattttatagaacagcagcgcgacggcgagcgcgataaccaccgtccacgaagcggcaacatagcctttcagcttgagtttaatcagggcgaaaaagaagaacaggattgggagcgatgcgatcaggctggaaagccagatattacccgccgggtcatagttttgttgccagaggttcattgcaggtctcctgagaaccacacgcataatgggatgaatctttgctcatctagttgaagtcacattatgtgtaaaagtggtcctgccaatattgttgtgtatggataatgacaacaaatagttaaccggatgttatttattggcaacgatattgtagagttaatttagtgaaatgtgagtaggctgtggtaactggctaaaattggtagggccaattgagaggagaggaccacaaagggaagtgaaaaggcaatggcattatgccattgcctttgatgtcgggagtgttgttacttcattaccactggaagcccgcgccaatggctgcagagtaatcgccctggctgttgctggttccttgcagtttatacacccagcccccgctttcacttaccatggagacaccaatggcgacggcactttcaccattaaacgtaccgccagcaatcgaggtcatgttggcgcccggggcgtaggcttgtggcagaccggccatcgccatcgctgaagcgataccgccgctcatcttgttttctatgcctttgattttgctgttcatttcccccattttctggtcggtataggtgtttgcttcttcgacgctgcgtttcaattgcgcatagttaaccgcatccgtatcattcaccgccgctgaaacattgccgatccgagtggtgccgccactcccgtctcccaggttgagcacgctatagttaaccgagccatctgcattggtttcataacgcacggagcctgcttctgaggctttcagttgcgccacattaaccgcgtcagtgttgttcacccctgcggcaacgttggtaatacggcgttgttgagtagaagagccgacagacacagtattagcttcatctgcgacggaatttgtgcctaacgccacgctgttttcagcggcagcaatagagccagagccaatcgcgacgctgtccgcaccctgggcatttgcatctgcgccatcggtgttggtcttgaagtacttggtgctaccggtagtgacgatatcgccaatgccgttttcgatattggtgacgcgggtatccagattcgatacctgagtattcaggttagtaatgctctgggtattcctggaaacctgcgcgtccgttactttcaattgaccaacgttaacggcatcggtatctgccgaacccgccgcgacgttagtgatctgacgttgaccgtcttcactgccgacagagaactcaccgacagagttctgcggtgtgtccatgttgtaggcggtgtagtcagtctgtgcaccgcgagtggtctgagaaccattacccattgcaatactgtttgcatggttggcgcgtgcgttagaaccgatagcaatcccgttgatggcatcagccatcaccagtgtattcagaccaataccaatacctgcatcagcattgacgatagtcttcgcacccattgccagtgagtcagttccgacagccagtgaatcttcttccgttgagtttgcgtggtagtacttggtcggtgtagtagtgaccgcaccaatggcattttgtaactgacgaactgttaccgcatcttgcgcttcagagccgtcagcaacgttggtaatttgacgatagctttctccatccgtccccaatgacaacgcgcccagcaactctctgtctgttgtattgtagccaatcaccacgccatcgcttgttgcgctcgtttctcgtataccggttgtaatagcgcggttagaggtggagccactgcccaaagcgatactgccctcaatgctgctgctgctgttttggccaagagccagacagccagcgccagaggcgacggcgtcgtaacctactgccgttgcgccgttacccgttgcgtatgcatcctggccttcaagcccgttatcattcgtacggatgtatttcacgccggtaccattttccgtgatataggtttcgctggtatcgccggctagttggctaatagattcattatactgagaaatcagcatgttagtttcatagagctgagagccattaatggcgtcagtactgtcactggcgatttcacctgctgctacattagttatcttattggtaccgctggtaccgtggctggcgctgaacgcaccctcttcgtcatcccagctcagtgcatcggtaccaaggttggtgatggacgtattgatatccgcgatagcagaggtgttttgatccaccttctggttggtttcatacaactgtgatccgtttaccgcgtctgtactgtcctcagaaagcgccccggcggcgacattggttattttactggtgcttccaccgtggtttgcgctgaaagcgccggtgtcttcgtcccataacagagcgttatcagtgaggccggtaatggacgtattaatgtcggagacagaagtattcaggttctcaatcgcggtgctgttctgagtgatgttggtggtattggcggcgatatcggtcgtgttctgatccactttttcattggtttcgaacaactgcgatccgttaaccgcgtcggtactttcttcagacagctctccggcagcaacgttggtgattttgtttgtcgtactacttccgtggctggcagagaacgaattcgttgtttcattccagctcaggttgtcagagctaagattggtgatggacgtattaatatctgcgatagcagaggtgttttgatccaccttctggttggtttcatacaattgtgagccgttaacggcgtctgtactgtccgcggccagggtacccgccgccagattggtgattttgctggcgcttccgttacggctggcgctgaatgtgccagagtcagcatcccataacagggcatcgtcggtgagcgtggtgacggagttgctcagattgttgatactggtggtgttggtggcaatatcagtggtgttctgattgatgctgttggtattggtggtgatatcagcggtgttctgatccactttctcgttcgtatcaaacaactgggagccattaaccgcatcggtgctgtccgcggccagggtgcctgccgccagattggtgattttgctggcgcttccgttacggctggcgctgaatgtgccagaggctgcatcccaaagcagggcatcatcggtgagcgtggtgacggagttgctcagattgttgatactggtggtgttggtggcaatatcagtggtgttctgattgatgctgttggtattggtggtgatatcagcggtgttctgatccactttctcgttcgtatcaaacaactgggagccattaaccgcatcggtgctgtccgcggccagggtgcctgccgccagattggtgattttgctggcgcttccgttacggctggcgctgaatgtgccagaggctgcatcccaaagcagggcatcatcggtgagcgtggtgacggagttgctcagattgttgatactggtggtgttggtggcaatatcagtggtgttctggttaatgctgccggtatcgttccctgcattggccagcgcatctgcagagaccataatactgctaagaccgacgagtgcggaaaccgccagctttctgcggccgcttttttttccgcggctttttgccgtctcgctggtgacaataaatgttcccgtagcggcattccagaggactttaaatattctgttcatgaataagtgctttccttttctaaaatagttgtatcaatggctattatttttttggcttctttttcgtatcattaataggttgtatgctgtcgaatatgacattctccatgtcaatacctatttttagatacttaagattattgggcgatacgccttttaatgttagcgtgacgtttgtccatgctcccggtaagagttcgattgtcgagtccattttcgtgttgagcaggagttgtcgccagcgaggcagatcttttgcctcggaaggttttttcgtaccccatgtcatattaaacgcaaggtttgatacgggaatgctgagtaagttaactaaatcaagatgaataacacttccattatctattggctcaatagatagaatacgcccggctaatccgatattgccgttgttaataataaaatagtgcgtttgtgatgggtccagttctgtatagtcgaatagccgttgtttgcgttcaacgcggccaacgacttcggcgatcttttgagtcgtgttgataaccgtagtttgttgtttttctggcaaatttatctttacttcttgttctttttgttgtttttctaacaggtttatctttgcttcttgttctttttgttgttttttcagttcttcaacaaggtgcttatctgcgaagtaatcacaaccagacaaaaaaaatgtgaatcccaaagcaagcagggggataaattttccatttttgtacatataaaatatccttgttaataatttatataatataaatagttaacctattatttatacagccaactcatcattttgcgggcattgccaatagccattaacgtatggttataatgaaaacattcattgcttctataggagtgtgcaaatacccgacgttgtttatcaattactcataacaatgctttataaaaatataattataatatttatgtatgagcattttttttcatggatgataatgttatttaatttcgcgggtcaattatattctgcgggttatgagaaaagaggatgaaaaaattcattgtataaatacaaacaggcacgatagtggaattttttatcctgaaaaagcagggattgccgttaaaaatgaacttgtatataaacgatgtaaatacttctaggaaaaattcggaatatagcccgatgcattcaagacaccctccgtacaacgggtgtcttgagagcctgggatgcggaaggtttagaactcgctcttcgcgaaacctgtcatctctttgagtcccatttcccggcccagcgccgtcatcgggtgcactacgatcagaccacgcacgcttttcttcaacttgcccatatcggcctgctcttttttagtgatagcgcggcgaaacggcaggttcatcagcttctgcgcttctttactcagtttctggctgtgtacttcgcgcagacggataatttctgcttccagcgtctctttttctttttccagctccgcgtatttatcggcggattcaaccagcgagagacctgcctgctggtggcgaatagcgtcaagacgatcgctcaggcgtttaatttcgtttttttcgacttctttcatgggatagcttctgatagaaatgggatagataccctatagtatgcgcgcagtgggtgattcttcacaactcatggcgtaacgataatcaattatggtaaatattacaccgctaattatttatttatccatttgaaaataaagtgctttttttcgaaagaaaagatgaaacgcctttttgtcggcaagaaaagcaattaagcacattttcctcaatgatgacgctaaatcgatcctaaactcaaataagcggccgcgggagtcagacgcggatcacacatggaggatctatcatggcaaaaataggtgagaacgtaccacttcttattgataaagccgtcgattttatggcgtccagccaggcgttccgtgagtacttgaataaaacgccgccgcgtgattatgttccttccgaagtgccgtcggagagcacgcccatttatttgcagcgtctggaatattaccggcggctgtaccgaccaaaagaagaaagaggttaacggcgggatttacttttgaaaggccttttttaagctgattttagaaatcagctcggtcagagagagaaccatcgtcgaacgcaccgcctgctggtagcgctgaatttgcatggcgtatagcgccgcgtcggatgtatcaaaatgtggcggcggcggcagcgccatgacgcaatgcagttcgccaaacggcccgaggatttcatcgtcggtaaaggcgtactcattgccgtcgtgattcagctcttcgcgcagcgccattaacagctccgcatcttcatattcggtgcggctgagtacgcccaggccatagataagtttcagacgtaccgaaagatcgcccagcggcccgtcgccgtccagcaacggttccacagcgtatttcacggcatagtcgtctttgcgaaacacctgaagcaccagaatattcaccgcctcggtcagtaactcgacggcggtaatcaggaagctccgtacggttttgccagcattcagacgctcaagcacacgattttcaaaggcctgggtttgttccattattgcctgcatatctgacaatctgttatttgggcgcaggctaacctgcgccgggttctgcgtcatttggtcgcgttatatgcgttaaccgcctccgccaccacatcgctattggcatccagcccggaaatttgcgccagcgcggcctgcgggcctttttcggtaatcagcgccgccaactcttgtgcctgcggatcttcatcgctacggaaatgcatcgccgccgcgatccctttcaccagattcacatgcggcagaccatattccagggtgccaagcagcggtttgatcagacggtcgcccgcgctgagtttgcgtagcggctgacggcctacgcgttcgacgtcatctttcagatacgggttttcaaaacgaccgaggattttctgaatgtatgccgcatgtttgtcggcatcaaaaccgtagcgtttgatcagcaccgcgccgctttcttccatcgcgcctttcaccaccgcgcgaataccctcatcgagaatggcgtcgcgaatggtttgatgaccggctaatttgccgaggtacgcggttatagcatgacctgtgttcagcgtgaagagtttacgttcgacaaatgccatcaggttatccgttaactccatccccggaatgtttggcaacgcgcctttaaactgggttttatcgacgatccactcgctgaaggtttctaccgtcacttccagcggatcgttggtcgcagaagcagatggcggcacaatacggtcaacggcggaatcgacaaaaccgacgtgctgttcaacccaggctttatcgccatccgccagcgcgttcattacgtggcctttcagctgcgtggtgccgcgcaccatattttcgcaggcgatgatattcagcggggcatccacgccctgcgccttacgttttaccagccctttagcgatagccggtgcgatacgctcaagcaccaccgggcccacggcagtggtgattaaatcaacgtgggcaatcaggtcgacaacatcatcgccgatgctgctgacagcgttgacgccggaaacggtatccacctgctcattttcacccacaacatgaacctgatagctatgacgggcattcagggcatcgagtacgacctggtttacatccgcaaacgtcagttgtatccccgcgtcagccagcaatttgccgataaagccacgaccgatattacctgcgccaaaatgtaatgctttcatagtattaaccttcattaatgtttttacccgagagggctggggtgaggcttttccctcaacctaaccctctccacaagagagaggatatcgccttcatatttagaactgcagatgcgttggctctcctcgctcaccccagtcacgtatttatgtacgctcctggggattcactgcgttgccgccttcctgcagctcgaactattttggggatacttaactgttaagcttttttacctgccagcagttccagcacttcatccacgctggtggtgtgcgccagacgttcgatcacggattcatcatccagcgcgttggtcaagctggtgatgacctggatgtgctcattgttacgtgcggcgataccaatgaccagacgggcaatatcgtcttcttcttcaccgaagcgtacgccttccggatactggcagaacaccacgccggttttcagcacgcggtctttagcttctacggtaccgtgcggtaccgcgatggattcaccgaggtaagtcggcgtcagcttttcgcggtccagcatcgcctcgacgtattccggctcaacatagccgcctttcaccagttgttcaccggcaaagcgaatcgcctcttctttgttagcggctttacggcccaggaagatattctccgcgcccagcttgaacaggttgttatcgccctcttcaaagctatctttcagatgatcgcggactttctcttcattagtattgtggcgctgtgcggcaaccagacgttcggtcaggctggtgtacaggccgctatccaggaagttggtcagcgaaatatgctgcgcctgcggtacctgacgcatagcacgttcggtcaggtcgcggtgagtaatgaccagatccacatccggcggcagattgttaatggcgctgttggtgacggaaatctgagacagacccgcatcctgtactttcttacgcagtacccctgcgcccatcgcgctggaacccataccggcatcgcaagctacgatgattttacgcacatggctgaggtcattggtgacgtcgccagccgccagcggagaggcgcctttagattccgctttcatgtcatgcatacgacgggtggccgcttcaatatcatcttcttctttcactttgctggttttcagcagaattgcagacaccacgaaggagaccgccattgccgccacgatggccgcgatgttagcgaagtaagcgccttttggcgtcatcgccagtaccgccagaatggagcctggagacgccggagagaccagaccgccgttcaggatggtcagggtgaatacgccggtcataccgccgagaatcaccgccagaatcaggcgtgggttcatcagcacgtacgggaagtaaatttcgtggataccgcctaggaagtggataattgccgcgccgcccgcagactgtttagcgctgccgcgaccgaagaacatgtacgccagcaggacgcccatccccggacccgggttagcttcaatcaggaagaagatggatttacccatctcatgggactgctggatacccagcggtgagaagatgccgtggttaatcgcgttattgaggaacaggattttcgccggttcaacaaaaatggacgccagcggcagcatatcgtgcgccaccatgaagttaacgcccgccgccagaattttggacaggacttcaaccgccggaccaataccgaggaacgccaggatggcgaggatcataccgatgatgccagcggagaagttgttcaccagcatctcaaaaccggatttgatcttaccgtctacccaactgtcgaatttcttaatgcagtagccgcctaatggaccggcgatcatcgagccgaggaacatcggcatatccgcgccgacaataacgcccatggtagtaatagcgcctaccacgccgccgcgttcgccgccaaccagacgaccgccggtataaccgatgagcagcggcagcaggtaggtgatcatcggaccaaccagtttcgccagcgtttcgttaggcaaccaccctgttggaataaataatgcggtgataataccccacgcgataaacgcgccgatattaggcatcaccatattgctgaggaatcgaccaaagctttgcactttgatcttaatatcggatgacataaaaacaccccttcttatgttgctgtcgcgcaggctgaaagcccgaggtttgttaatgtagcggcagaggtagccggaccctgtagtgtagatactgcgcaatctggcactgaatcgttcaactgtccagacaaggataatttatgtgatttgcgtcacataaatataggggtagagaggtaatttatgtgatattgatcacaaagttactgtgtaaaaaaacaacgaatctcatttttagcccttaaaaggctattttatgtgagatatttcacacttttattttggtgctttgttgaatttttgtgatcctcttcacatgaaattttaagcccgggtaacgtcaatacgatccgacaaacattttgtcgcgagccctctcacgttatgtcattcagcaacttccttttgtgtctcttttcgtcttatttgagccatactatgatttttactggttggcaaaaaggacacggcatgaaactcatcggtagctacaccagcccttttgtgcgcaaaatctctgttctgctgctcgaaaagggtattaccttcgaatttattaatgaactaccttacgaggcggataacggcgtggcgcaatacaaccctctgggtaaggtgccagcgctggtgacggagaaaggggagtactggttcgattcgccgatcatcgcggaatatattgaactgctggatatcgcgccagcgatgctcccgcgtgacccgatggcagcgcttaaagttcgccagcttgaagcgttggctgacggcattatggatgcagcgttggtgtctgtacgcgaacaggcgcgcccggcggcgcaacaatcggaaacggaactgctgcgccagcgggaaaaaatcaaccgcagcctggatatgctcgaaagttatctgagcgacgggacgctaaaaacggatacggtcaatctggcgactatcgcgattgcctgtgcggtaggctatctcaacttccgccgggtcgcgcccggctggtgtgttagccgcccccacctggtcaaactggtcgaaacgctttttcaacgcgaaagctttgcccgcaccgaagcgccaaaggcttgacgcgcattatgtccgcctgagcaaactcacgttacaatcccccttatgtcgatatccctctcccgccaggagagggccaccaacagccaggcattttcatgacaagcgaaacgcgtacactctacagccagcttcctgctatcgatcgtttattgcacgatagcgcctttctttctctgcgcgatcggtatggccatacccaggtggttgatctgcttaggcggatgcttgacgacgcgcgcgacgtcatacggaatacgcaaacgcttcccgactggtacgcagactgggcgcaagaggcgaaactccggctggaaaatgcggcgcaaagcgcgctgcgcccggtgattaacctgacggggacggtgctgcacaccaatcttggccgcgcattgcaggcgcaagaagcgattgaggcggtaacgcaggcgatgcgcgcgccggtgacgctggaatacgatttagatggcgccgggcgggggcatcgcgaccgggcgctggcgacgctgttatgccgtatcaccggggcggaggacgcctgtatcgtcaataacaatgcggcggcggtattgctgatgctggcggcgaccgccagcggcaaagaggtggtggtttcgcgtggcgaactggtcgaaatcggcggcgcgtttcgtattccggatgttatgcgccaggcgggctgtacgctgcatgaagtgggcaccaccaaccggacgcacgcgaaagattaccgtcaggcggtaaatgaaaataccgggctgttgatgaaggtgcataccagtaattacagcattgagggctttaccaaaacggtagaggaagcggaactggcggaaatcgggcgagagctggatattccggtggtggcggatctgggcagcggttcgctggtggatttaagccaatatggcttacccaaagagccgatgccgcaacagctcattgccgcaggcgtcagcctggtaagcttctccggcgataagttgttgggcgggccgcaggccgggatcatcgtcggcaaaaaagcgatgattgcccaactgcaaagccatccgctgaaacgcgctctgcgcgcggataaaatgacgctggcggcgctggaggcaacgttacgtctgtatctgcacccggaagcgttggcggagaaattacccaccctgcgtctgttaacccgcagtgaagcgtcgattcgcgaacaagcgcagcggttacaggcgcggttggcggcacgttacggcgatgaatttgcgctggaggttaaaccctgtctgtcgcaaatcggcagcggttcattaccggtagaccgcctccccagcgccgccatgacctttaccccgcacgacgggcgcggtagtcggctggaggcgctggcggcccgctggcgcacgctgcctgtaccggtcattggccgaatttatgatggccgtttatggctggatatgcgctgtcttgaagacgaaagccggtttatggagatgatgctgaaatgattattgcaactgccggacacgtagaccacggtaaaacgacgttgctccaggcgattaccggcattaatgccgatcgcctgccggaagagaaaaaacgcgggatgactatcgatctgggctacgcctattggccgcagccggatggtcgtgtgctgggctttatcgatgtgcctgggcatgaaaaattcctctctaacatgctggcgggcgtaggcggtatcgatcacgctttgctggtggtcgcctgtgatgacggcgttatggcgcaaacgcgcgagcatttacagatcctacagctgacgggcaatctccagctcaccgtcgcgctgaccaaagccgatcgcgtggacgaggcgcgtatcagcgaagtacgtgaagaggtgctggcggcgctcgacaactatggcttcgccgataccgttttatttgtcaccgccgccaatgaaggacgcggtattgcagaacttcgcgctcatttacagcagcttcctgcacgtttacacgccgcgcagcatcgcttccgtctggctatcgaccgtgcgtttacggtgaaaggggcgggactggtggtgaccggaacggcgttgagcggagaggtaaacgtgggcgatacgctatggttgaccggcgttaatacgccgatgcgcgtacgaagtctacacgcgcaaaatcagcctaccgaccatgcgtatgccgggcaacgtattgcgctcaatattgcgggcgatgcggagaaggagcagcttaaccgcggcgactggctgctttccgatgcgccggcgggggaggctttttcccgggtgatcgtttctctggcgcttcatgcgccgctttcccaatggcaaccgctacatattcaccatgccgccagccatgtgaccggtcgcgtctctttgctggaaggcgcgctggccgagctgatctttgatacgccgttgtggctggccgataatgacagactggtattgcgtgatatttccgcacgcgccacccttgccggcgcacgcgtggtgacgcttaacgcgccgcgccgcggtaaacgtaagccagattatttgcactggctttcaacgcttgccgatgcgcaggacgatagcgcagcgttggccattcatctggaacgcggggccgtcaacctgccggatttcggttgggcgcgtcagcttaatcctctcggtatgcgtcagcttattgagcaacatggttttatccaggccggagacaatctgttaagcgcgcccgtcgccgcccgctggcagcgtaagattcttgatacgctggcgacctaccacgaacagcaccgcgatgaaccggggccgggacgcgagcgtttacgccgcatggccctgccaatggaggatgaagcgctggttctgatgctgatcgagcggatgcgcgacgagggcctgattcatagccatcacggttggttgcatctgccggatcataaagcgggatttagcgatgagcagcaggccgtctggcaaaaagtcgaaccgctatttggcgatgagccctggtgggtacgcgatctggcgaaagagaccggaacggaagaacaattgatgcggctggtgctgcggcaggcggcacagcaaggcatcattaccgcgatcgtaaaagatcggtactatcgtaacgatcggattgtcgctttcgccaatatgatccgcgagctggatcaagagagaggatcaacctgtgcggcggattttcgcgacaggctgaatgtagggcggaaactggccattcagattcttgaatattttgaccggattggatttacacgacgtcgtgggaatgatcatttattacgtgatgcgttattatttccgcaaaaagaatgaaatggttaaattaaataacaaatgaagcaatacaattattgcgttgctttataaaaagcacatcagcaaatgaacctgatgtgctttttatttttctggcttcttaaaatagccatcgtgagcctattatcagaatagttttgcccatattctttgcgccttattcaggcgactcacgacgagattgtggaactttatcgcgcggcgatgtaacgcctttgcccggtggcgcggacgcttaccgggcctgcgtagacgatgcaggccggatagggcgtaacacgttatcttcggtcgagcttttgctgcgccagccagacggcgcccagcctgcctgcctgatttcccagttggcagggctgaatcggcacctggagcgcctcccacatttcaaacgtttcaagatgccgcgtcaggagcgggtagagcttttcctgttcgcttattcctccgccgatcagcaccacgcccggatcaaacatagagatcacgctgtaaacgccgcgtgacagataacgcgcccagtcattgaccgcctcacgcagatgaacatcggtcgccattcgttcgaagatcacatccgcaggcggcatctcttctgcaggcagcgccagagcctggcggcacgacgccattaatccgctggttgacgcgattttatgcatactttcgccattattcccgaccggcatgacgccgaattcaccggcgtggaaatgtgcgccgcgatacagttctcgtccgacgataataccgccgccaatgccggttccaatggtgatacagaccagattgtcataatgctgcccggcgcctcgccacatttcgcccagcgccgcgcagttcgcgtcgttctccacgaccagcggcagatcggttagcccgctgaacaactccatcaggttgacgtcatccaggtatgccagcgcgcccgcttttgccgcatgaccgttatggggattaatatggccggggaaactgaccccgattgccgcaatgtcatagtcctgctggcaacgcgccaccacatcctgccatttgcgggtaaacgtggaggcgtcctctggcgtatcgaattgatgatgggttaattcttcgccgtcactgttaatcacgccatatttgacgtgagttcctcccacatcaataccgatatattgctgcatagtgttctccgtacgttaaacaggcacctgtttagtatggctaaaaccagacggagaaacgtaaaggaaagtaattcgtgattgctgtcgtaaagcgagaaaccattggcgaaaaattcaccagtaccgtctacccttgtggagtacctttacaataaggagttggtcatgacgaacaatcccccttcaacacgtattcagccaagtgaatacgggtacccactgaagttaaaagcccgctatgacaattttattggcggtgactgggttgcgcccgccgacggcgaatattatcaaaacctgacgccagtgaccggccagccgctatgtgaagtcgcttcctccggtaaaaaagatatcgatttagcgctcgacgccgcgcataaggcgaaagataagtgggcgcatacgtcagtacaagaccgtgccgctatcttgtttaagatcgccgatcggatggaacaaaacctcgaactgttggcgacagcggaaacttgggataacggtaaaccgattcgtgaaaccagtgccgccgacataccgctggcgatcgatcatttccgctatttcgcctcctgtatacgtgcgcaggagggcgggatcagcgaagttgatagcgaaaccgtggcctaccattttcacgaaccgcttggtgtcgtggggcagataatcccgtggaactttccgctgctgatggcaagctggaaaatggcgccagcgctggcggcaggtaactgcgtggtgcttaaaccggcacgcctgacgccgctttccgttttactgttaatggaagtcattggcgatctgttaccgccgggcgttgtcaacgtcgtgaacggcgcgggcggcgagattggcgaatatctggcgacctcaaaacgtatcgcgaaggtggcgtttaccggttcgacggaagtgggtcaacagatcatgcagtacgccacgcagaacattattccggtgacgctggagttaggcggcaagtcgcccaatatcttcttcgccgacgtgatggatgaggaagatgcgttctttgataaagcgctggagggatttgccctgtttgcctttaaccagggcgaggtgtgtacctgtccaagccgtgcgctggttcaggagtccatctatgagcgctttatggagcgcgctattcgccgggtggagagcattcgcagcgggaacccgctagatagcggtacacagatgggagcgcaggtctctcacggccagcttgagactatcctcaattatatcgatatcggtaaaaaagagggggccgatattctgaccggtgggcgacgcaaggaactggatggcgaacttaaagagggctattaccttgagcctaccattctgtttggtaagaataatatgcgcgtctttcaggaggagatctttggcccggtgctggcggtaaccacctttaaaaccatggagaaggcgctggaaatcgctaacgatacgcaatatggcctgggtgctggcgtctggagccgcaacggcaatctggcctataagatggggcgcggcattcaggccgggcgcgtatggaccaactgctatcacgcctatccggcacatgcggcgtttggcggctataagcagtcgggcatcgggcgcgaaacccataagatgatgctggaacactaccagcaaaccaagtgcctgttggtgagttattccgataagccgctggggctgttctgacgcaagaggtaatgcccgatggcgctgcgtttatcaggcctacaagaatttatcgcaatatactgatattgcaaatcttgtaggccggataaggcgcagccgccatccggcacagtattaccgctcgttaatccaaatccgcatttcgccctcgccacggttggcccagctaaaccacggaatgaatgttagcgtctgcggctgacgcgatgacggcgcgttatcgtagtgccacaacgcctgatgctgcgcatccgcggcgctttgcttctcgccttcggcctgaatcagcatcttatgcgcaaaaagccctttgccctcaaagacccggaactcactctctttcggtagccacagattatgcagttcttcgccgttatcggcctgctcaaggcaatagaccagcggcccgcgctgaatagcgaccttaccggcgacgtgacgcgccagcggattgccatacacgcggcgaaccggcatcggcagcgtcaggcttatcgtatcgccctcctgccaggttcgacggatatgcagataacctttgcgaatatcctgctccacttccagcccgttgagcgtcacttttgcctcagggcaccagtccggcagacgtagcgccagcgtgtgacgtaccggctgcacagaatcgatggcgatcttcacctgctcatgccacgggtagttcccgctgattcgcagtttgagcgcgccattttcaaccggtatttccatgctgttacccacgtacatattgatgtacagcgcatccgcacgcggcgtgtagatgtagtgaccaatggacgtgagtacgcgggcgatattcggtgggcagcaggcgcagccaaaccagcgctggcggatgggtttaacgtgatcgtagatatggttgaattttaacgattttggatgcacttccagcgggttgacgtagaagaaatgcttgccgtcgagcgccataccgccgaggacggtgttgtacagcgcgcgctccatcacgtcggcgtactggctatcggcttccatttccagcatccggcgggcgaacatcatcaggccgattgaagcgcagctttccgcatagaccgaatcattcggtaaatcgtaatcgctgctaaaggcttcgccgctgctttgtgaaccgatgcctccggtgatatacagctgacgctgcgccatatttttccacaggcgcaggcagtcctggcgtttgccttcatcgttgctcaggcgagcgagatgcgccacgccagtcatcagatagacaaaacgtaccgcgtggccgattgccgtctgctgctgcgaaattggcagatgcgcctggctgtaggctttgtctttgaccatccacgccgggccgtaggtatgccagtaagaggtttggccgcgtttttcgtactcttcgtcgtagaagtgcggttgggcgccgcgctgcccgataaagtaacttgccagcgtcatatagcgcggctgctctgttacctcatacagacgcatcagcgccagctcaatttccgggtggcccggataaccgtgcagctgattttcgccagggccgaaagtgctgtcgatatgatcggccagacgacaaacgacgtctagcagccgacgcttgccggtggcctgaaagaaggcgacgcccgcttcaatcagatgcccggcgcaataaagctcatggcactccgccaggttgctccagcgttcttgcggggcttttgccgtaaagtacgtattgagatagccatcgtcacactgcgcggcggccaccagttcaatcacctcatcggcggttttctcaagctctgggtcgggtttttggcacagtgaccaggcaaccgcttccagccatttcgccacgtcgctgtcctgaaagaccatgccgtaaaagtcgcccgtctgctggcctgcggcaatgcggaaattttcaatggcatggctgggttcagcctctggaatacgatcgtttaacgcatcccactggtaaggaataaccacatcgcgaaccagttgttgatactgtccgagtaacggatcgctgaccgtcagtttatgcagatcgacttccagtacgttcatttcgtgctccttaaggctgtagaggtcatagatattcctcgctgacggggtattttatggcagtaatttttattttcgcgttatgacctgattcattttgcccagatagcggtgagcgacaaggcgataaaagagtaaaaaaagatgacgattccgactcgtatttaaaaatgtgagatggatcgagtgaaatgactatttttagttaataatcaaaaagtaatatgaaatacggtgctgaatgagcgggaaataacatattaatgctcgaattatccataacattaccgattaaagtccaaaacggcggattatttatttctcgcggcattgggcgtcatcctgccaggcgtctgcaatcgtgggaaattatatttgtggaaaaaggctgcctgaaaattcaggaagaatgtgttttctgtgtcgaagccggggaaagcctgttgctttggccgcatcgccgccatattggcgttgaggagtttcccgccgatcttaaattttactggctccattttgaggtcaaagcgccggacagcgacccgcgctggctgacgcatctttccgtgccgcagcatacccaggttgccgatccgcaggcgctgattgcgctttttcgccagtttatgaacgagcaggaaaagcaccagcgcagtccggcgctggagttcatcgtgctgctgattttgcagcagctcaccgttgacgcccggcagaatgaaaacgccgaggccgctggcgtgtcgctggcctggaaagcgcagcagctgattcgaacgcactatcacctgccgctttccagcgcggttctggcgaaagaactgcattgcaatgtggattatctgggacgcgtttatcggcgggtatttcaccttacgctaacggaagccatccaccgccagcgggtgcgcgaggcggaaaagttgctgattagcgacgcgcgttcgttaaaagaggtggcggagcggtgcggttttaatgacgttggttactttcgccagatcttccgcaagcacaccggcctgacgcctaccgcctggaagcggcgctacagtaaggaacacgttaattcttgagtataatctttggccctctgacaacgcggttgcaaactgaatgcccgatggcgctttgcttatcgggcctacaagagttcatcacaacgtattgatattgcaaatcttgtaggtcggataaggcgcagccgccatccgacacaggctgtgactgccgatattactgcccgtaataggcgttcgcgccatgtttacgcagatagtgtttatcgagcaattccggctgcatatccggtagctgcggggccagctggcgcgagaacagccccatataggcgcactcctcaagcaccacggcgttgtggacggcatcggcggcatttttaccccaggcaaacgggccgtgtgaatgaactaataccgccgggatttgcgccggatcgagaccgcgctcttcaaaggttttaataatcacctcgccggtctgatactcgtactcgccgttaatttcctcaacggtcatcagccgggtacaggggatcgcgccatagaaatagtcggcgtgggtggtgccccaggcgggcagatcgagcccggcctgcgaccagatcgtcgcatggcgggaatgggtatgcacgatcccaccgatctgcggatagcggcgatagagcgccagatgggtcgcggtatcggacgacggttttttgttgccttcaacgaccttaccgctggcgatctctaccaccaccatatcgtcggcggtcatcacctcatattcgacgccggaaggcttaatgaccatcagcttgcgcgtctcatcgaccgcgctgacgttgccccaggtaaaggtgaccagcccgtgcgccgggagggccaggttggccgccagcacctcggctttcagttgctctaacatgtgaaacctccttcctgcatccgtgattcaatccagcggcgggcctggataatttccagcaccggctcgctggctttctctgtccacatctcaatcagaaatgaaccgcgatagttcagctcatgcagcgttttgaagatgctgacaaaatcaacgcatccttcgccaaacggcacgtcgcggaactggccggggttgtcaccggtcaccggcagcgtgtctttcaggtggatcgcggcgatacggtcgatacccagcttcagctcggcggtcacgtcgttcccccaggcgctgaggttgccgacgtctggataaacggtgaaccacggtgacgaaagcatctcgtcccactttttccacttgctgatggagttcataaacgcggtatccatgatctccaccgccagcatcacctgcgccgctgcggcctgttccaccgcccacgccagcccttcggcgaaacgttgctgggtgccttcgtcgtgctcttcgtaatagacgtcgtaacctgccaactggatggtgcggatccccaggtcgcgcgccaggcgaatggctttggtcatgatttcacgcgcccgctggcgtaccgcttcgtcgcggctgccaaaagggaagcgacgatgggcggagaggcacatcgacgggatggcgacgccgctttccagcatcgcgttcaccagcgaagcgcgttgggccgaggtccactccaggcgtgagagacgttcgtcggtttcatccaccgacatctcaacaaaatcaaaaccgcagctttttgccagcaccagccgctctggccaactgagatctttcgccagtgctttctcgtaaatacctaatggatgattacgcatgcttttctccccaaatggcgtcaatttgggcgtggaattcggcggcgacctgcgccggatgggcggcacctgccagcgcacgtccggcgataaatgccttaacgttaatgtcgcggaacagcggcagatccgctggggtaatgccgccggtaatcgatagttcaaggccgatgtcggacaacgccttcatacgcgccaggtccgcttctccccactgctgcccgctggcctgcgcatcgtgtccgcggtggtaaatcgcctggcgaaccccgacgcgataccagtctcgggcgtcgtccagcgtccagttgccgaacagttccatttgaatttcaccgccgcaggattgcgcgacggcatggcctttctcgacggtcgcgagcggcgcggcgcagatgatagtcatccagttagcgccagcgctaaaagcctgctgcgccagggtttcaccggcatcggccactttccagtcggcgacgatgattttttccgggcactgcgctcgcagggctttcaccgcgctaaggccttcggttaaacaaaggatggttccggcctcaacgatatcgacatgatcctgtagcagggcgacatcgcgctgggctgcttccagactggtgtggtcgagcgccagttgcagtaatggtcggctcataatgcgtgctccttaatacgggcgtgatagccctgtagtgcttcaatcaaatcctggtattggcggtatttgcgctggtagagggcgtgcgcggtcatgtccggcagcagcgtgcgtaccgggtgctgcaggtcgcgttgggcctcgtggaaatcgcgatatacgccggtgccgacgcgggctgccagcgccgcgccgaagcagccggtctcctccacctgcggcagctcgatgcgtaacccgctgacgtccgacagcatctgcatccagacgtcggagtgggccggtccgccggtaacgcgcagggcgcaaacctcggtaaagcgttcacgcatgcggttgaggtgggtcatatggctgaagaccacgccttcatagagcgcctgtagcaggtgcgcgcggttgtgcagcgcctgcatgccataaaagccgcaggtcatctccagcccggcattgctgccgtagagaaacgggagaaaaaaaaggtcgctaccggctttcggcaggctggcaaccgcctggttgatctcgtcaaaagagaggtagccccactgggcggtgaaccattcaaggttgccggaagaggtcgggctggcttcgtgaacgatatactgcccgtcattgacgtagcggccatagacgtaaggatgggcctcatggtcgcgcagaccgtgagcgatgccgctggtgacggcccaggtccccatcaccgcattgagcgttgattcatcctcaataccggcgcaaagggcggtggaaaccacgtcaaacaggccgccgacgacgggggtacccgccgccagaccggtgatagcggccgcctgagcggtgatctccccgcatatttcggctgaacccaccacggggggcagcgcgctatcgatttcactgatgcccagccattcggtcaggcgcgggtcgtactggcccgtcgccatgttgtagaggttggactcggagatattgctctcctcacagcctttcacgccggttaagcaccagcgcagatagtcatgcgtcatcatgacgctgcctatctgcgcgtagcgctgcggctcattctcttttacccagcgtaaaagggagaccggatgcccggtccacagggtttgccgggtcagtgggtagagtttttgcggaaccgcttctttttgccagcgctggacaatttccatggcgcgacgatcggaagagagtatcgctttacctaatggccgatcgcttttatctaacaggaacaggcctttcccttgggctgaaatacccagaccgcggatttgtgagccgctcacccccgtgtgcgtcagcagtttgctgatgaccgaagcgcactgttgccacagttcggtcatatcgcgttcaacccagcctggctgcgggcttaaagcgtgcagcggcaggcgttgcaccgctacttcccggcctgcgccatcgtacaacccggcttttagccaactcccaccacaatctaaccccagccagtaattgctcatgacttattgcacctcgtccacggctttcaggaggtcggcgccctgcgggttgtctttcaggaacatatcgcgcacctggctgcccagcgcatcactgaaggctttacggtcgatatcggtcaggacttcaactccggcttctttcatgccatcgataattttttgctgatcttcggcgaccagtttgcgctggtagtcccccgcttctttggcggaactcagcagtgcctcctggaactgcgggcttaaagcgtcgaatttggctttattgatcaccagcagcagaggcgaataggcgtgatgagtgagggagaggtatttctgtacctcatagaatttcgctgaccacacgacgttgatagggtgttcctgggcatcaatcgtacgggtttcgaggccggtatagacttcggagaatggcatcggaatagggttcgcgccgaagattttaaaggccgcgatattcattggactgttgttagtgcggatttttaagcctttcaaatcgcccggcgtttttaccggcgcgcgggagttggtgacgtcgcgccagccgttttcccagtaggcgaggacttttaacccttttgaatcgagtgattttttcagttcatcgccgactttaccgtcgagcgttttatgcgcatgcgaggtatcgcgaaacaggaaggggacatcaagtaagttgaatacaggggccaggccggtgaaattgttcgaaccggacatttccatatcaatagttccgccgcgcaccccgctgatcattgcctgagcgttacctaatgtgctgtcaggaaagagttttagcgttaattcgccgttggttttttcttttaataattcgttaaattttttcgcggcaatatgttgggagtcagtttgcggtgtttcataaccaaaacgtaaagattgcgccgccagagacgacacgctgaaaaccgtcagaccagctatcaataatgaacgagcaataacgtgtaatttcataatattatcctttaattaatccatttaagcggtgtgataattagctcgggaataaaaataaataaaaccagcagcgacatcagtacgacaacgtaagggaatacgcctcttaccgcgtcatcaaatttcaattttgctaccccggaaataacgttgaggacgttgccaacgggcggtgtgattaatccaatagagcagttaataatgaacatgacgccgaaataaatcgggtcaatattggcttctttaactaatggcaataatacaggggtaagaattaacaccgttggcgtcaaatccatcaccataccgacgaccataattgagatcataatgacgataaataagagtcgcggagagtcgaccagcggctgcagcaaatctgacactatcatgggtaattccgcgatcgtaatcagccaggcggatacctgggccgcggccaccagaaacatgacgactgacgtcgttttggcggcattgaccagcacgtggtagagactggaaaacgttaattcccgatagataaccacggcgacaaagagggcgtaaaacgcggcgaccgcccctgcctccgttggcgtgaaaagtccggaacggaagccgccgatgataatcaccggtaaaaacagcgcccagatacctgaaaccaatgaataccagatttcacgcggtgttgctttaggctgagaagggagatttaatcgcccggcctgccaccaccaggtgagcataagcgccgcgcccatcatgatgcccggtgcgatcccggccataaacagcttgctgatcgacaagccgctggaaacgccgaagataataaaaggaatcgaggggggaataattggcgcaatgatcccgccggaagcgattaacccaacggagcggttgatcgggtagtttgcggagcgcatcatcggcaccagcagcgcggcgaccgcagcggtatctgctaccgcagagccggaaaggctggccataatcattgccgcaataacgcccacgtagcccaggccgccgggcttatggccgaccagcttcatcggcaggtcgacaattcgctttgacaggccgcccgcgttcatgatttcaccggccaaaacaaaaaagggaatggccagtagggagaaactgtccgcgccgttaaccagggtttgcgccataatctgcacgtcaaacatatccaggtatgccatcagagcagcgccgcaaagcagcagcgaccaggcgatgggtaaacctatcgcgatcccgccgagcaggcagcagagaaatatcaccacggccatgattaggctccttgctgtggttgttgaaaggaatcgttacgcgttattaagtgataaagccgacgcagctcgattaacgcgatggcaacgcttgtgggcagacaggcgatatacatcaggccgatcggtaaaccgagaattggcgagtgatcgctccagtcctgcaacgctttttgcaggctgccccagcctaatgcgatgcataacaataaaatcagcgaatgtgtcagcagcgagagtcgacgctgattcgctggcgaaagtttttccaccacaaaagtgacctgaacgtgagcgttatccataaatgcaacgatggcgccaataaacgtcagccatacaaatagataacgtgatagttcatctaccgacaaaatactgctctcaaaaccgtaacgtaaaataacgttaataaatacaatgcaggaaagtacggcaattaataccgcaagtatgccctcaagtacccgcttcataacgactccatcaggttatagaaacttatttctttcgatgctgaatagtggaacttaatttcttatgtttggtttatattaggtcggcgcaacgttgagttgcaggccgagaattaaggtgatgatgtttaattcaggttagcggcgtgtggcctttttcatcatgttaataccatcgcgtaatatatttatgcggtgattaatatcggcactggcattgatttccaacaatttaataccggtaaactgcaacagttcgggagcggcggcggtaatcagttctttaacatgtttctccgtcatcagactttgtggacagaaaggtgcaaacggagcatggaggtcctgccattcgccgtattctccatccagcgttgtaccggagaacatcagcgccccgagttttccagcctgtttggcctgctgcgtgtggatcagcggtagagaggtatcccgcccttcaatagccgagcgcgcccagttaatgcagacgcttatgtcatagtcggcaatagtttccagtacgtttaccaacggtaagaatcctttgcgcggtgcggggccggtcatcgcgtcgcagtgttcaagcaccaggtcgcaggaccagtcccagttggcaatctcttttaatgagcgcgcaaaggcgtcggttgcctgcgccacgttcggattgcccgccagaggagcggcatgaagctcaagggctatgactttgccggtattgttcccattgattttattgatcttctgatgcagatgacgatagtactccacgcaggctttacgctgttcctcgtcactggacgctaatccaaaaccgccgttttcgctacggcgacgcatggtttccattatcgcggtgaccacgatttgccagtttcccggtgtatggcgcaataaccactcgtcgccgagcgggtgaagatgttcaagacaaggctgctccagcccccggatatccggagtatcagagagttgccgccagaattccgtctcttcctcttcactcttctggtgaaatgagggtgcacaagggtacgcaccgataatataaccggtattatttttcattttgtgctccagtaaactctattttataaaacgtctatggcgacttttacgactattttccgtatcggcgtagcaatgcttttattacaaccgggacgatgaacatcctgcgggaaaaacagggcataacttcccggtatcatttcaatgaatgattcatgttcactgtcgtgataaaaaataatatcgcgctgttctaataatgactcgctgatttgattattaccggtatcaatggcaaccccaattttctcttcaccccatgccagaaactgaatatccagatagcggcgatggacttccggacgattttcagcagcatcgcgggtggtcatatcgataatctgcgcgaaggtatttttgccgtcgatttccactacgccgggttccagcgtgcgaaagtcggtggtacgtaaaaagtgaagcgctttctcgatcgcggctggcaaatgacatggatttggctgcgcgatatgtccaaaaatcatgatgtggctccttacagcgcctggattttagcccagacgctgtcgtcaatggtgataccgttacagcggctgtcatccagcaatttggtaaattcgtggccgggcagccgaatcgcgacgttgtcgtcagcacgttcagcagtggtgatgaaatccataatccgctgcagtttggcatcgcgggttgcgccatcgatcagcttatccacttctatggcgatgaaaatctgcgaaacgccatactcatcgctgttttcctgggtcacttcggcaacggaagagccgttggaaagcagggtggcaatcatgtccagcacaatcgacagaccagatcctttccagtaacccatcggtaaaatgcggtgatttttctcgatcacgcccggttctttggtcaactgaccgttatcgtcgaaaccgccgtccaccggcagttcgcggcccgccagacggttaacttctaacatcccgtaggagaacatcgacatcgacatatctaccatcgtgatcggcgtagacgggatggcgacgatcagcggattggtaccgatacggcactctttcgcgccccacggcggcatgacggcgatggagttggtccagcaaatgccgatatagcctttttccgccgcctgccagccgtagctgccgccgcgcatccagtggttagcattacgtaacgccaccaggccaataccatgatcggaagccagctcgatggcccggtccatcatctttttcgccgtcaggttgccgatagcgcgctgagcatcccactgttcgatggcgccgaggctggtaacccgctgcggtttagcatcaggaataatgtcgccgttatccagttgctggatgaagcggggaaagcggttcacgccgtgggaatagacaccggactcggtggtgcgagcgaacatttccgcgcaggcgtcggcggtatcttccgcaatattccgcgaccgcaagacgcggtagaaggccccttttaactcttcgaaagttactttcatccctgttctcctggtcgattgttagaaattttagtatgtttttttgtcgataaatttcataatgcgaaatgtagttccaaatatatagatcaaaaattgacatggcaacgccagagaagctttttaaaaacgattaaaatcatcgggttatgttttttatgctgatatcgtgaactgcaacacactttgagctaccatctgatcgcccaagaaaggagagagttttctgatgagccagaacaacgataaagagaagcctgcggggagtcagagcctgtttcgtggcctgatgttgatagaaattttgagtaactacccgaacggttgcccactggcgcacctgtcggagctggcggggttgaacaagagtaccgtccatcgtttgttgcaggggcttcaatcctgcggatacgtgacgccagcgccggcggccggaagctaccgtctgacgacaaagtttattgccgtcggccaaaaagccctgtcatcgctgaatatcatccacgttgcggcaccgcaccttgaggcgctcaacctggccaccggcgagacggtgaatttttccagccgtgaagatgatcacgctatcctgatttataagctggaaccgaccaccggtatgctgcgcacgcgtgcctacattggccagcatatgccgctgtactgctcggcgatggggaaaatttatatggcgtttggtcagccggattatgtggcgtcttactgggaaagccataaagatcagatccagccgctgactcgtaataccattaccgatttaccagcaatgtacgatgagctggcgcaaattcgtgaaaccagcatggcgatggatcgcgaagaaaatgaactgggcgtttcctgtattgctgtgcctgtgtttgatattcaccatcgagtgccttacgccatttctatttcactgtcgacgtcacggctaaaacagatcggcgagaaaaatctgctcaaaccgttgcgtgaaaccgcacaggctatctctaatgagctgggatttaccgttcgcgaataagacagctcgccaggttttatcaggcatctgacaaaatttgtccgtttgcgtagtgggatcaaagcggcggggaatggctctctggcattctggcgttttaacgcagggggagaacaatgaaccggtttattatggcggatgcgtcggcgtgtatcgggtgtcgtacctgcgaggtcgcctgcgtggtgtcgcaccaggaacagcagaatagcgcggcggtgacgacggcggactttgtgccgcgtatccgggtgataaaagaggatagcttcaccacggccacggtctgccatcagtgtgaggacgcgccgtgcgcgaatgtctgcccggtacaggcgattcgccgtgatcgggggcatatcttcgtgacgccatcgcgctgcattggttgtaaaagctgtatgctggcttgcccgtttggcgcgatgactgtggtggcgtccgcgtcaggcgcgcaggcgattaaatgcgatctttgctggcatcgggaagcggggccggcgtgcgtggaagcctgcccgaccagtgcgttacagtgcgttgacgcaacacacgtgcagcgccagcgcctctattctcaacctttctgaacatcgttccggcctgcataatggccggaataaccgtcagccttcacgccaggcgcgttctatctcttctgccagaatttttacgcccgcctcgattttatccggttcaggcacgtagttcatccgcatacactggtgtgtgtgcggccagggtttatccagtccgggaaagaaatagtggcccggcaccatcagcacgccgcgcgctttcaagcgttgatagagtagctcggtggtaatcggcagatctttaaaccacagccacaaaaatattgcgccttctggtttatgaatcaggcagcgttcttcggataaatagcgacgaatgatcgcgatcgtctgttgaacgcgctgatagtagaaaggtttgataaccgtttccgacagccgcagcagatcgttacgcttaatcatttcgcacatcatcgccgggcccatgcccccgggcgcaaggctgatgatgccgttcatgttggcaatggcggtaatcgtcttatcattggcgatgataatcccgcagcgggaaccgggcagccccagctttgagaggctcatgcataggataatattggggttccacagcgggcgcgcctcgctaaagataatgcccggaaacggtacaccgtaagcgttatcaatcaccagtgggatgttgtgctgattcgccagtctgtccagcttcatcagctcttcgtcggtgataacgttaccggttgggttggtcgggcgcgagacgcaaatcatccccgtttcttcgccgatgtgcagatgctcaaaatcgacgtgatacttaaactggccttccggcagcagctcaatattcgggcgcgccgaaacgaagaggtcgtcttccagaccggaatccgcatagccgatgtattccggcgcaagcgggaatagtacctttttcgtactgccgtcggcgcgacgtccggcgaagagattaaataagtagaaaaacgcgctctgactgccatttgttagcgcaatattctgtggttcgatatcccatcccagcgtttcacgtagcagtacggccagtgcattcagtagcgccgtttttccctggggaccgtcataattacaaagcgcatcagcggctttgccgctttctaccatctctgtcagtagcgtctggaaataatcctgcattgcagggatgtgtgccgggttaccgccgccaagcatgatggcgcctggcgtgcgtaagccgtcgttgagatcctccatcaggcgggtaatgcctgaatggcgggtaaatttatcgccgaaaagtgaaaatgtcataacgggtgatctatcgaactgtctgtcaaagtggataaccataacgctacaaatggcggggcgcaaatgggggacaggcggtggtattgatgttttatgctacaaatttttatcagtttagttttttattttgaagaggttaccggtacgcgaggggaccggtagcgccacgattagcggcggcccgcccagacgaccatcaccgtatcgtcgccgtactggcgtacaaaaccgtacccgtgttttagcgtcagcgtggtttgttggcctgcgccgatggcgggatgtctggcgcggaactggctaatacgctgccagtgcgcgacggctgcggctgactttccgctcacgtcctgccagttcatatcagaacgggtgccttgcagcgggtcggagccggtggggccgaagggacgagcggattcatcgccgtaaaagatctgcaccgcgcctggcgaaagcagcagcagttccgccgccttatcaccgccctcacggaaaaggcgcgtatcatgcgaggagaggtaacttaatacgttgaaatcctgcattttatccgccatctgctgccagactggccccatttccgccaggcaatcgaccgctttcgccgcctgctcctgataatcaaaattgatcatcgcgtcgaaaccatagcgataataatcacttttcatgacgccgtggccccacgcttcgccagtcatccagaacgggctatcatccagcgctttgtccggattggcctgcttccattcatgtaacgccgcgctggcctgggtttttagctgttgccaggcaggaagctcaacgtttttggcagtatcgatccggaacccgtcaatgccgtaatcatgcacccactggcttaaccagtgagtcagataatcccgtggcgtatagccctcaatgaactttgctttagtatcgggtttgttggcatagaacacgggtaggccggaaggcgtggtagattccgtttttatatccggcaggaaggccagcgacagggttaaatcgtcaaatcccggactgtcgtagtcgccaatatcggtacgaatccactttttcccccaccatttttcccaggcggcgctgtcgctgaagttgatgtagtcgttaaagctgtgccagctttgtccggcggccggtcgccagtttgtccagcgatcgccgagaattttttgccgttccgcgccggataaatagagcgcgccgaactgatactcctgcatatccgccagcgtggcgtaaccggcatgattcattactacgtcaaataaaatacggatgccgcgctggtgcgcgccgtcgaccagcgcgcggagatcggcttcgctgcccatattggcatccagcgtcgtccagtcctgagtgtaatagccgtgataggcgtaatgaggaaaatcgccttttgttccgccgccgacccagccgtggatctgttcaaacggcgagcttatccacaaggcgttcacgcctaattgctgtagatagtccagttgactcgtcaacccgcgcaaatcgccgccgtggaaagtgccaatctcttgcataccatccttatggcgaccataactgtggtcgttggttggatcgccattgcgaaagcgatccgtaagcacaaaataaacggtggcgttgcgccagttaaaaggcgctgacgcatgggtttccgcgcgttccagcaataaaagcccgtggctgtcggcaggtagcagcgtgatttttccgttttggacggtatcgatttgaccactgtaataatcgcgcactaccgtcccttccggaaaggtttggcgaacatccagcgtgagcggcgaaccatcccagacgggacactggtaggcgagctgcgtggtgcgttcaggttcagtttttatcgataacaacagggtcggcgtaccggatcgggtatctaccgttatcgtatagtcgccatctttaaacagacgccattgcggcggcgcgccttcgcagggttttaacgacaacatttggttgagttttatagcgccggagggctgccagcactgctggtcaatatggagcgttaacgcgcgtgtaccttttgttaatgcagcatggctggtaaagcgtccggtttcctgcgtcgagagcgtcggaaaaccgggcgaggtccatgatgaggcgatcgcgataccgggtatcagcgtcagagcgaaggcggcaagtttcatcacgctatcctttgtgggcaatattcatcagcttgcctggtttttaggcgaatgaactcctccccagcagagagtcgcgcaggaggaggcgcgagggtgagcgacgaggcgcaaaaaaacgcctctatttgcgataaacgccgcattttattggcattattgctgtctgttatcgttaatagttgacatagtttcggattaagactattccctgaggtgctttttaagcctatttttgctagaatttggggttcaaacctcaacttcgtgaaaaataaaaggtgttggaatgtatcaatccgaccaggagacctaatgatattgactcccatgcgacgatatggggcaatgattcttatgttactcaccatcgcattttcgggtgaggtgctggcaaagacgcgcgcaacacaaacgagtcaaaagtcccacataactgagacaagttataaacaggttagcagtaaacaagagtattctcgcaatagtgcaaagagcagttcacttcctgatttgcgaaaatacccttccggaacccccagaaaaaaagcgtttctccggaccgttatgccttacatcaccagccaaaatgccgcgattaccgcggaccgtaattggctgatctcaaaacagtaccagaaccgctggtcgccgtctgagcgcgcgcgtatgaaagatatcgcgaagcgctataaagtgagctggtccggcaacacgcgtcgtattccgtggaatacgttgctggagcgcgtcgacattatcccaaccagcatggtggcgacgatggcggcggcggaaagcggctggggaacctctaaactggcgcgtagcaacaataacctgttcggcatgaagtgcacgaaagggcgttgtaccaatacgccgggtaaggtgaaaggttactcgcaattcgcgtcggttgaggagtcggtgagcgcgtatgtcgccaacctgaacacgcatccggcttattcttctttccgcaagtcgcgcgcccaactgcgtaaggcggatcaggaagtcaccgccacggcgatgattcataagctaaagggttactctacccagggggcgcgctataacaactacttgttcgcgatgtaccaggacaaccagcgtctgatcgccgcgcatatgtaattctgtgtgccggatggcgctacgctatccggcttacaaggcatctgtaggctggataaactacaacaacgcttcactatgctggtcgcgatactccttaggcgtagtgacgtactcctttttaaacaccgaatagaaatattgcagcgacgggtagccgcacatttgcgaaatttcgtttatcgccaacgtggtggaaatcaacaaactacgcgctttttccagcttttcggcgtggatcagcgcatgtatcgtctcgccaacttcttccttaaaacgtttttccaggtttgaacgtgaaatcccaaccgcgtccagcacctgctcgactttaatgcccttacaggcatggttacgaataaagtgcatcgcctggataaccgccggatcggtcagggagcgatagtctgtcgagcggcgcgcaatgacgcgcaccggcggcaccagaatgcgctgtaacggcatctcttcgcgcgccagcaaacggtgcagcagcttcgccgcctgatagcccatttgccgcgccccctgcgcgacggaggaaagcgcgacgcgcgacagataacgggttaactcttcgttatcaataccgataacgcaaagtttttccggcaccggaatatgcaggtgttcgcaggcctgcaatacgtgacgggcgcgggcatccgttacggcaatgatgccggtttgcggcggcagcgtctgaagccagtcggcgaggcgattttgcgcgtgctgccagttttccggcgcggtttccagcccctgatagactacgccgcggtatttttcctcggcgaccagctggcgaaaggcgtattcccgttccgccgcccaatgtttgcggctggagtcgggcaaaccgtaaaacgcgaagcggttaacgcctttttcttttaaatgcaggaaagcgctttcaacgagcgcatgattatcggtggcgatgtaatgaacggcgggataattttcagcaagatggtaagaaccgccgaccccgacaatgggtacgtcgacatcggccaataattgcgcgatatcgtcatcatcgtaatcggcaataacgccgtcgcctaaccactctttaatgttatcgatacgggcacggaaatcttcctcaataaatatatcccattcggattgcgaggcttgtaaatattcacccaccccctccactacctgacggtcataggctttattcgcgttaaataacagagtgatacggtgacgtttatcaaacatgaggatatatcctgcaaaagtgaacctggactcatggatactatcaaaacggctgacataacggtctggcgaatgatgacaaattattttgcgcctgaaacgttatgcgaaattcatcacagcaaacggcggatgacaattgtcatttcttatctatatattacggttttttgtttatttgccaggattcgatcgcgatcgcttttttcttctgtggttttcagcgtttttttgagagccagagcacatttggggattctcttaatagcggtgtgaaataacgtaattgagcaataaatcaggaaattccagtatgacgttatgtcgtttacttgccgtcttatctgattatggagctcactatgcaggcttattttgaccaactcgatcgtgttcgctatgaaggccctcaatcgactaacccgctggcatttcgtcattacaatcccgacgagctggttttaggtaaacgtatggaagatcacctgcgtttcgcggcctgttactggcataccttctgctggaacggcgcggatatgtttggcgtaggcgcgtttaatcgtccgtggcagcaaccgggcgaagcgctggagctggcgaaacgcaaagcggacgtggcgtttgaatttttccacaaactgaatgtgcctttttactgcttccatgacgtggatgtgtcgccgaaaggcgcgtcgttgaaagaatataaaaacaacttcgcgcagatggtggatgtgctggcggcgaaacaggagcagagcggcgtaaaactgctgtggggaacggcgaactgctttaccaacccgcgctatggcgcaggcgccgccactaacccggacccggaagtctttagctgtgcagcgacgcaagtggttacggcaatgaacgccacgcataaactgggcggcgaaaattacgtactgtggggcggacgcgaaggttatgaaacgttgctgaataccgatctacgccaggaacgcgaacagattggccgctttatgcaaatggtggttgagcacaaacataaaatgggtttccagggcacgctgctgattgaaccgaaaccgcaggaaccgacaaaacatcagtatgattatgacgttgcaacggtctatggcttcctcaaacagttcggcctggaaaaagagatcaaagtgaacattgaggcgaaccacgccacgctggcgggccattcgttccaccatgaaatcgcaaccgctatcgcgctgggtatttttggctccgttgatgccaaccgcggcgatgcgcaactgggctgggataccgatcagttcccgattagcgttgaagagaacgcgctggtgatgtacgaaatcctgaaagcgggcggattcacgacgggcggtctcaacttcgacgccaaagttcgtcgccagagcaccgataaatacgatctgttctacggtcatatcggcgcgatggatacgatggcgttgtcactgaaaatcgccgcgcgtatggtcgaagacggcgagttggataaacgcgtggcgaagcgctatgccggctggaatggcgagctggggcagcagattctgaaaggacaactctccttaggcgaactggcgcagtatgcggagcagcaccatctggcgccggtacatcaaagcggtcatcaggagctgttagaaaatctggttaaccgttatctgtttgataaataactctatctaccgggcgactccgcgttagcccggcctgtagtcgtgattagcccggtaagcgtagcgctgccgggcgctttcagtaaaggaacccacactatgtatatcgggatcgatcttggtacatcgggtgtaaaagctatcctgttgaatgagcagggcgatgtgctggctacgcatactgaaaaactgaccgtatcgcgtccgcatcccttatggtcggaacaggaaccagagcagtggtggcaggcgacggatcgtgcggttaaaggtttaggtcggcaacagtcgttaagtggcgtccgggcgttgggcatcgccggacaaatgcatggcgcgacattacttgatagccgtcagcaggttctgcgaccagcgattttatggaatgacggacgctgtagcgaagagtgcgcctggctggaaaaacaggtgccgcagtcgcgagcgataaccggtaatctgatgatgcccggttttaccgcgcccaaattagtttgggtgcagcgccacgaaccggatattttctaccagatagacaaggttctgctgccgaaagattttctgcggctgcgaatgacaggcgtctttgccagcgatatgtcggatgcggcgggaacgatgtggctggacgtgaaaaagcgcgactggagcgacgttatgctcaacgcctgtcatttaacccgacagcagatgccagcgttatttgaaggtagtgacattaccggaacgttgctgccagaggtcgccagcgcatggggaatgccagcagtacctgtggtggcaggcggcggcgacaatgcggctggcgcggtcggcgtaggaatgatcgatgccggacaggcgatgctctcactcggaacatcgggcgtctattttgccgtcagcgacggctttctgagtaaaccggagagcgcagtacacagtttttgccatgcgctgccggaacgctggcatttaatgtctgtgatgttgagcgccgcctcttgtctggactgggcggctaaactcaccgggcaggagaacgtcccggcgctgattgccgccgcacagcaggcggatgagcatgccgattcgatctggtttttgccgtacctgtccggcgagcgcacgccgcataataatccgcaggcaaaaggcgttttctttggtttaacccatcagcatggcccggcggaactggcgcgggcggtactggaaggcgtgggatatgctttggcggacggtatggatgtggttcacgcctgcggcgtcaaacccgccagcgtgacgcttatcggcggcggagcgcgcagcgaatactggcgtcagatgctatctgatattagcgggctacagcttgattatcgtactggcggcgatgtagggccagcgctgggcgcggcgcgtctggcgcaaattgcggtgaataaacagactccgctcgccgatgtattgccgcagttgccgctggagcaggcgcattatcctgatgcgcagcgtcatgcggtttatcaacaacgtcgtgaaaccttccgtcgactctatcagcagctgttgccgttgatgtcataagtcagaatgcctttcagttttggctgaaaggcatttcccgtaaatattgattctattgaattatatcgaagtaagtatgtgtgttttctgatttttatattattgctgagcaggcgcctttttcatcgctatttcttcgcttaatgtgtctcactcaaccacaaggagagtgagatggacgatcacgttgcacgcaggaaacggatattcggcctgggaatgttagttgtcggtgcagtggtatacttggtgggattgtggccaggctgtcatacattaagcgaaaagggatatttttttgcggcaatcgtcatgtgcggttttccagtcttaattcgccaggaacacacggggaatgaccgcttgctttctcgttgtaaatctttgctgttgcttggcatcggcatggtcgcggtcggcgtatttaacctggcgctggcgggcgcgctgaaaatactgtgtctggtggcgctgggggtcagtatatatggaaccgatctttacgcttcctacagtgatgatgaatgatggccggagccatcattgtcgtttagctaacccatttccgtttatcaatacgctgtaacagcatggaaagtagcaggcttcctgtcaccgtcgcggcaaaaacccacacgatgtctaacggcggccaacgttttaattccagaccattagtacgtagcgcatggataatcagcgcgtggaaaccataaatacccagcgagtggcgggagataagccccagtctaggtaacgtccgcgcattcagcttatttttaactaccgtgaacagtgagacggcgcaaataaacaccatgggaccgcaatacagataccaggtatcggcaaaatttccgcgccagcgtaattcatgcaatgtgccgcgagaaataacaaataccgcgatgatgaacagggcagcgcagataagcgtcagcgatggcttttgcgtctccatcattccaatggcgcggcccaggataccgtagagaatgtagtagaacgtgtcgccgctgatatacagattgatgggcaaccattcaacgccgccgattttttgcggcacagtatttgggttagcaataataccaatgatcaccatcagcatcaggagcattttgccgctcacgttttttacctggattaatggcgataccaggtagatcaccgtaatcgcaaagaaaaaccacaggtggtaaaacacgggtttttgcagcgcattttttagcgaaagctcgacgttgatcgaagtaaaaagtgaaatgtaagccagggcgacaacgctgtaaaagataaggcacagggcaatacgtaaaaaatgccgcggttgcgcgcagcgctcgccaaaaaaagatagcctgaaatcataaaaaacaggggaacgctaacgcgcgaagccgaattcaggacattcgcaatatcccagtttagcgggctgacgctgtgggcgttggtgatgtaccacgttgtagtatggatcatcactaccattaaacaggcgatccctcgcaggttatcaatccagttaattttaggctgcatcagttcctcagcttccgtttcaatagagttccagcgcggtggctcactggaaaaatccgactttctacgctacatcttgtgatggcgtaaggagattcgcacaatgtttctgttacccacaaaccttaataataagactgaccagcaaaccagacggtaataaaaatgataatgaagtatttctgtactgtgatgatagccatcgctctggtgggatgcacagcgacaccgccaccgacgcaaaaagcccagcagagtaaagtgagcccaacacgcacgctggatatggaagcattgtgtaaagctcaggcggcgcagcgttacaacactggcgcacagaaaattgctgttaccggcttcgaacagtttcaggggagctatgagatgcgtggtaataccttccgtaaagagagttttgtctgctcttttgatgcagatgggcagtttttacatctttctatgcggtaaaagccgcgcctggtgaggtgtgatgccgcgaaatccggtaattttcgctaaacaaaccggtttcatactgtatatctcgcatccagcgggtatactggctccttcctttaaatccacacgtatccagcacgaaataatatgcaaaagtttgataccaggaccttccagggcttgatcctgaccttacaggattactgggctcgccagggctgtaccattgttcaaccattggacatggaagtcggcgcgggaacttctcatccaatgacctgcctgcgcgcgctggggccagagccgatggcgactgcctatgtgcagccttctcgtcgtccgaccgatggccgctacggcgaaaacccgaaccgcttacagcactactatcagttccaggtagtgattaagccgtctccggagaatattcaggagctgtacctcggttctctgaaagagctgggtatggacccgaccattcacgacatccgtttcgtggaagataactgggagaacccgacgctgggtgcctggggactcggctgggaagtgtggctgaatggcatggaagtgacgcagttcacctacttccagcaggtcggcggcctggagtgcaagctggtgaccggtgaaatcacctacggtctggaacgtctggcgatgtatatccagggcgtggacagcgtttacgacctggtctggagcgatggcccgctgggtaaaactacctacggcgacgtgttccatcaaaacgaagttgagcaatccacctataactttgaatacgccgatgtggatttcttattcacctgcttcgagcagtatgagaaagaagcccagcagctactagcactggaaaacccgctgccgctgccggcctacgagcgtattctgaaagccgcccacagcttcaacctgctggatgcgcgtaaagccatctccgtcaccgagcgtcagcgttacattttgcgcattcgcaccctgacaaaagcagtggcagaagcatactacgcttcccgtgaagccctcggcttcccgatgtgcaacaaagataagtaagaggcggctatgtctgagaaaacttttctggtggaaatcggcactgaagagctgccaccaaaagcactgcgcagcctggctgagtcctttgctgcgaactttactgcggagctggataacgctggcctcgcacacggcaccgttcaatggtttgctgctccgcgtcgtctggcgctgaaagtagctaacctggcggaagcgcaaccggatcgtgaaatcgaaaaacgcggcccggcgattgcccaggcgttcgatgctgaaggcaaaccgagcaaagcagcagaaggctgggcgcgtggttgcggtattaccgttgaccaggctgagcgtctgactaccgataaaggcgaatggctgctgtatcgcgcctacgtgaagggcgaaagtaccgaagcactgctgccgaatatggtcgcgacctctctggcgaagctaccgatcccgaaactgatgcgctggggtgcaagcgacgtacacttcgtgcgtccggttcacaccgtaaccctgctgctgggcgacaaagtcattccggctactattctgggcattcagtccgatcgcgtgattcgcggccatcgttttatgggcgagccggaattcactattgacaatgccgatcagtatccggaaatactgcgcgagcgcgggaaagtcatcgccgattacgaagaacgtaaggcgaagattaaagccgatgccgaagaagccgcgcgtaagatcggcggtaacgctgacttaagcgaaagtttgctggaagaagtggcttcgctagtggagtggccggtcgtactgaccgcgaaatttgaagagaaattcctcgctgtgccgtctgaagcgctggtttacaccatgaaaggtgaccagaaatacttcccggtgtatgcgaacgacggcaaactgctgccgaactttatcttcgttgccaacattgaatcgaaagatccacagcaaattatctctggtaacgagaaagtcgttcgtccacgtctggcagatgccgagttcttcttcaacaccgaccgtaaaaaacgtctggaagataacctgccgcgcctgcaaaccgtgctgttccagcaacagctgggtacgctgcgcgacaaaactgatcgcatccaggctctggctggctggattgctgaacagattggtgctgacgttaatcacgctacccgtgcgggcctgctgtctaagtgtgacctgatgaccaacatggtcttcgagttcaccgacacccagggcgttatggggatgcactacgcgcgtcacgatggcgaagcggaagatgtcgcggtggcgttgaacgagcagtatcagccgcgttttgctggtgatgacctgccgtccaacccagtggcttgtgcgctggcgattgctgacaagatggataccctggcgggtatcttcggtatcggtcagcatccgaaaggtgacaaagacccatttgcgctgcgtcgtgccgcacttggcgtgctgcgtattatcgttgagaagaacctcaaccttgatctgcaaacgctgaccgaagaagccgtgcgtctgtatggcgataagctgactaacgccagcgtggttgatgatgtcatcgactttatgctgggccgtttccgcgcatggtatcaggacgaaggttactccgtcgacaccatccaggctgtactggcgcgtcgtccgacccgtccggcagattttgatgcccgcatgaaggcggtgtctcatttccgcaccctggaagaagcctctgcgctggcggcggcgaacaagcgcgtctccaacatcctggcgaaagccactgagccgctgaacgatatcgtccacgcctccgtactgaaagaagcggcggaaattgagttggccagacatctggttgtgctgcgtgataagcttcagccgtactttgccgatggtcgttatcaggaagcgttgattgagctggcggcactgcgcgcgccggtggatgaattcttcgaaaatgtcatggtgaacgcggaagagaaagatatccgtatcaaccgcctgacgctgttgtcgaaactacgcgaactgttcctgcaggttgcggatatttcgttactgcaataagcgttcagttaaataaacaaaaacctgctctcgggcaggtttttttataacataaatagtattagttgattcgctaataattctgtaactcatagacgcggttatctctattgattggcaagaattatttcaggaatacattaacgctggcggtacggatattggcgttagaatagctgcgggtgcttgagactgtttgtctcaggtattcaccaaaaggcagacagagaaaatccccacctgactatacccaaaataattcgagttgcttaaaggcggcaagggagtgagtccccaggagcatagataacgatgtgactggggtgagcgagcgtagccaacacataagcaacttgaagtatgaagggtatataaatcaaaagtgcactgcgcccattattgatctcttcaataacgaagcgatctcctgcagtatttcagaacgtccaactatgccgatgatcgatgacatgctcatgaaggcatttgccagacttgatgcgggtaccaatccggttcttcattcagatcagggctggcaataccgtcattgatggtaccagtatcagttacgagagtttggcatcatccaaagtatgtcccgcaaaggcaactgccttgataatgcctgtgcagaattttttttcggcactttaaaatcagaaagtttttacaccagtaaatttaaggatattgatgaacttaagatagctattgaggattacatacgatactacaatacccgacgaattagccttagatttaacggactcagcccggttgaataccgcctaaagagctatccaggcagaaattaacaaggtctgtacagggatgctatcaggaaacctgaacgttggtggatacgctcacgtaaatgtctgctatgagcgaggagcggacgccctatttcacaaaaattagtattgttctacaagtaactctcacaatgaggttttatgaaaatcagaaggttcagtaatggggatgaaatatcgttattcagagtttttttctcatctgtacatacgatcgcatcacactactacacacgtgaacaaattgatgcttgggccccagcagatatcgacctggagcgatgggccaatcacattaaggaattacaaccttttgttgtagagctggatggtgaaatagctggatatgcagatgttcaaccaaatggatacattgatcatttctttgtatcaggaacctattcaagacagggggtagggacactactgatgaattgcattcatgaggaagccagacagcgtggaattagtgaacttacttcaaatgtaagtaaggctgcggaagtgttctttctacgacacggctttcatatagtggagcgaggctttcctatttgccgtggagtgacattacaaaatgctctgatgagaaaatgtttggcgaaataatagtcagcctgcagaaaggcagcattgttcttttgccttgttgaactcagtaaaccgctacaatgagcaacgtccgctgctggcgcaaagcggacatcagtattcaaaaaatgaaaaacgacgacttgatgtatatcgtttgctatacatggtggttgtgctattcttgtaaagcaaatgctatacaaggggtgtctcatgaaatcagatgttcaacttaaccttagagctaaggagtcgcagcgggcgctcattgatgcagctgcggaaatccttcacaagtcacgtacagatttcattctggaaacggcctgccgggctgccgagaatgtgatccttgaccgccgtgtatttaactttaacgatgagcaatatgaggagttcatcaatctgcttgatgcaccggtcgcagatgatcccgttatcgaaaaactgctggcaaggaaacctcagtgggacgtgtaacagcaccagaacctttgtccgcttttcatcaggtagctgagttcgtcagcggtgaagctgtgctcgatgactggttgaagcaaaagggcctcaaaaaccaggctctcggagcggccagaacatttgtggtgtgcaagaaagacacgaagcaagtagccggtttttactctctggccaccggtagcgtcaaccatacagaagcgacaggcaaccttcggcgtaacatgccagatcccatccctgtcattatacttgcccgtcttgctgtcgatctctcattccatggaaaagggcttggggctgatttacttcatgatgcagtgcttcgttgctatcgggttgccgagaatattggtgtacgtgcaatcatggttcatgcacttaccgaagacgccaaaaatttctacattcaccatggtttcaaatcatcacaaactcagcagcgaacattgttccttaggctccctcaatagaatgcaaagactgttatgttcaaatcgctataagcgataatttgatagaacgtctaaggttaaattcaggaagaatacgacgaacaaaatattgatgagacaggaatccgcgtgatgcaagaaagcaacggaatggataatccgattgcggacaatgttatttagttatagccagaaacaaaaaagagcccatgtattaaatggactctttcgctgatgcctcggttaatctgtccaggttttggggtcagtacaaagtgagcccacctctgccattcttgtggcgttatgcattctcaaggcactctgttaattttatcttgttggcgttttataggcccgataacccattatgttatcgggcatttttttaacgtaatggtaattccgtcagacaggtctggctgtcatctctggtggcaatggcatgtgacgccgttttaccgttgtagcttacttcgagcgtcccttccatattgcgcggtagccaaacaccgataaatccgtttcgatagctttgcatctctttttgtacgatgacagcgcctttactgtctgtcacttttacagtgaacggtttattcggcatttctccctgacagccggaaaggctgtggttaaaacaggggtgtgtccgccattcatagggcgcaaaagagagatagaatttgtcgcctaacggtagcgtataaatctgctctccgtcagataatttgagctcggtactggtaatcgacgcggagtaaggcaaaggacggctctgcggcgtctgatcaatcgtatccacgatctgctcaaccgtttttcccgccagcccatgttgcgccagaaaagcggattctgaggatgccgcaagcgcggagccgctggcgcataaacccaaaagtaataaccatgatgatttcgacataacttcaattccttgtgaacaatctccttgcctactataggggttcccctaagggaaaggtcaaagggacgcagggtaaagtaatgcaaagttatgctggggggggagatggggaattggaataaaaaaaatccccgccatcaggcagggattcaaaattctgagctttttaagcttacaggctggttacgttgccagctgccgggcctttagcgccgctttcgatggtgaaggaaactttctgaccttcgtccagagatttgtaaccatcgttctgaatagcggagaagtgtacgaacacgtctttagaaccgtcatcaggagtaataaagccgaagcctttatcagcgttgaaccattttacgataccagtcattttaccggacatagtgtattaccttttaaaaaataagtgtgcctttcggcgttatggcgtgctttacagattttttaagcgttaaggaaatgcgcactacgaggggtatctaatggataactcttgaagggacttgccttactaaactgctttaatggtctgtacgtcaaaccgttgagcacattaactcatgtaatgccgggcgatgcaacttttattttactttatttctccaggccagtaatcgggcgggggaaacggcccttacgcaggaccgttaaaacagaaaggggtaaaaattgctccatcaattgcttacttaagcgtgggttcgcctgtatcaggcgcatcaatttgagctctgctggcgtgggtttttcgcgtttcgattcccattcctgaaccatggcaaccgttacgcccagcgctctggcgaattcatctgtttttagtcccgttcctctccgtaactgttcaaattcggtaaaaggattgggtttttgcgtcagggtgatctttcgtgtttcatctttaaaaacaatttgttccaggctgctcagcagctcaaacatcggatctttatattccattgagaactcctgtaaatcacacagcgggatcgtgaaatgcatcgaagcctcttaagaatagtcgggaaacttgcgggtggggggcgacgcgccgccaggaagcgctatcgattcgtttcgatgccttacgctacgcgacttttaggacgctaacaatttgatccaggaagatatatccgtctttcagaaaataattgtaaagattaaaaaaatattacatcccccgctggaaagctttcttgccgcgttttttatcgcagtgtcaggttaaaaattaacaataaaataataaattaagcattgatgcagataaacataattttccgctacaagatcgcgtggaaagggtatcctgcaagcctgacctggactatccttgtaagccgtcaggcacgcaggtgtcgttgtgcgcatttttgggtgaaaggagtattaacaatggcgacaggtaagtcctgctctcgctggtttgcgcctgttgtggcgttattaatggtgtttagcctgagcgggtgttttgataaagaaggcgatcagcgcaaagcgtttgtcgatttcctgcagaatacagcaatgcgtagcggagagcgtttaccaacgctgacggccgatcagaaaaagcagtttggtccgttcgtgtctgattacgcgatactgtatggctactcgcagcaggtaaaccaggcgatggattccggtctgcgcccggtggtcgatagcgttaacgccatccgcgttccgcaggattatatgacgcaacgcgagccgctgcggcaggcaaatggttcgttaggcgtgctggcgcaacagttgcagaatgcaaaactgcaggctgatgccgcgcatggcgcgttaaagcaggccgatgacctgaaacctgtgtttgatcaggtctacaaaaaagtggtcaccgtgccggcagatgctttgcagccgctgatcccggcggcgcagatctttacgcagcagttggtacaagtgggcgattatattgcgcaacagggcgagcaggtgagctttgtcgcgaacggcattcagttcccgacctcacagcaggccagccaatataatgcgctgattgggccgttggcctcgcagcatcaggcgtttaatcaggcctggacggcggcggtaaacgcgacccagtaatgacagtctgcccgataagcgcaagccagcgcttatcgggcctgtagcgttatcccgccgcttgcggattgacgcagttcttctctatttttccctgcagcgcatcaatcaaattatccaccgcacaggccatcatgttgtagcgcgtctcatgcgttgccgagccaatatgcggcaccgcgacgacattagacatgttcagcaggggcgaatccacagatagcggttcctgttcaaagacatccagacctgccgcatatatttcaccgttttgcagcgcggcaatcagcgcgttttcatcgaccaccgggccgcgtccggcattaataaaaatggcggacgatttcattctggcaaactgtgttgcgccaaacagatgtcgcgtttctgccgttagtggcaggatcacgcagacaaaatcggcctcctgcaacaacgtatccagatcgcagtagcgggcgttaaaccggtcttccgcctcctgatgccgccgacgggcgtgatagagaaccggcatggtaaacccaaagtgcgctcgctgcgccagcgccatcccgatacgccccatcccaacgataccgagtgttttgtgatgcacatcgacgccaaaccatgccgggccaatgctttctgtccattcacccgccttaacccgttctgcgacgtccaccacgcggcgggcagtggccagcatcaacgccatcaccgtatcggcaacggtttccgtcaaaacggcaggcgtgtgcatcaggactattttgcgggcagtaagggcgtccacctcgacattatcgtatcccaccgagatggtcgacgccgcgcgtagcgccggcattttttccagcagcgcgcggttaacggtttcgctggtgcccagaaggccttgcgcgctggcaaatgcctgcgcgtgtcgcgcgaccgtttccggatgcaggttcggtacctgggtgacggtaaaatgcgcctccaggcgatgcagcaaatcatcaggcagggttttgtagagaatgatggacggcttcatgcgactctccgtaaatcaaaaggtaagcgcggcatgcgccaaccggaacaggcttattattaacccgtttagccatcatcgaccagccgatttccccgctgtcggcagccgtgtcgtggtaaatagtgaatgaatactgaataatgcgacgtgtatccggtctggcgagggaataatgcaggccgggtaaagcatgccgccttacccggtacggtagtttactgcaatggactcaaggtaatttcgacgcggcggttttgcgccttaccttctgccgtactgttgctggcgatcgggttcgccggacccattccgctggtacggatacggctggcgtcgacgccctgggtgatcagcgaactggcgacggagtcagcacgctgctgcgacagacgcatattcagatcgtggctaccggtactgtcggtgtagcccaccacattgacggcggtcttgggatactctttcagcaccatcgccacgccggtcagcgtgttagcgcctgccggtttcagcgtcgcgctgctgctgtcgaaggtgacattattcggcatattcagaatgatattatcgccgcttcgcgtcacgctaacgcctgtgccccgcattttgtcacgcagtttcgcttcctgtacgtccatgtagtaacccacgccgccgcccagcgccgcgccagccgccgcgccaatcagcgcgcctttaccgcgatcttttttggaggaggagagcgcgccgatgcctgcgccgaccagcgatccaatacccgcgccaatgccggatttacctgcttcgcgttcgccggtgtaagggtttgttgtgcagccagatactgccagggcgccgctcacgatggcagcaatcacaaatacacgttttttcatcttaaatccttatcacttttttatttttaccacagcgaccgtggcggttgattatgacgtctgcacatgaagaaaattccagggaaaactctgaaatttgtaagtaacattgatcggcaaaataaataatcccaataattcaggagcgaaccttgacccacgcaccatcgcgtcattcggtattgaccgccgcacactgggggccagtccgtgttgaaaccgacggagaacgcatttttgcttcatatggcgaactcccgacggcacaccagaactccctgcaaaccgttgtgcatgaccaggtacacagcaaaacgcgggttcgcttcccgatggtgcgtaaagggttcctggcttctcccgataagccgcaaggcatacgcgggcaggatgagtttgttcgcgtaagttgggatgacgcgctggatctgatccacgctcagcacaaacgtattcgtgaaagttatggaccatcgtccatcttcgccggctcctacggttggcgttcgaacggcgtattgcataaagcggctacgctattgcagcgttacatggcgctggcgggagggtataccggccatcttggcgattattccaccggcgcggcgcaggctatcatgccttatgtggtgggtggtaacgaggtttaccagcagcagactagctggccggtggtgctggaacatagcgaggtggtggtgctctggagcgcgaacccgctgaatactctgaaaattgcctggaacgcctcggatgaacaggggctcgactattttgcggcgctgcgacaaagcggcaaacgcctgatctgcatcgatccgatgcgatcggaaagcgtcgacttttttggcgataagatggagtggatcgccccacatatgggcaccgatgtggcgttaatgctggggatcgctcatacgctggtggaaaacggttggcaggatgaagcgttccttgcccgctgcacgacgggctatgaccgcttcgctgactatcttttgggcacgaccgacggtacggccaaaacagcggaatgggcggcggaaatttgcggcgtttctgcggtgaaaatccgcgaactggcggaaatatttcatcataacaccaccatgttgatggctggttggggaatgcagcgtcagcagttcggcgagcaaaagcactggatgatcgttacgctggccgcaatgctggggcaaattggtacgcctggcggcgggtttggtttttcttatcattttgctaacggcggaaacccgacgcgccgcgccgccgtgttagcgtcgatacaggggagcatccctggcggggtcgatgcggtagataaaataccggtggcgcgtattgtcgaggcgctggaaaaccccggtgggttttaccaacacaatgggatggatcgccgcttcccggatattcgttttatctggtgggcgggtggcgcgaactttacccatcatcaggataccaaccgtctgattcgtgcgtggcaaaaaccggaactggtcgttatctcggaatgtttctggacggccgccgcgaaacacgcggatatcgttctgcccgcgaccaccagctatgagcgtaacgatttaaccatgaccggcgactatagcaatcagcatttggcgccgatgaagcaggtcgtgtcgccccggtgggaggcgcggaatgattttgacgtttttgctgaactgagcgaacggtgggaagccggcggttatgctcggttcaccgaaggaaaaagcgagctggcgtggctggagaccttctacaatattgccgcccagcgtggcgccagccagggggtgacgctgccgccgtttgccgcattctggcaggctaaccgtttactggagatgccggaaaatcccgccaacgcgcagtttgtgcgcttcgcggattttcgccgcgatcctgataaccatccgctaaaaacggccagcggcaaaatcgaaatctattctgcgcgcattgccagctatggttatgcggattgtcccggtcatccgatgtggctggcgccggatgagtggcacgggaacgccgatgcggggcaggttcagctactttccgcgcatccggcgcaccgtctgcatagccagctcaactacagttcgttacgggagcggtatgcggtagccggacgcgaaccggtaacgattcatccgcaggatgcgacaacacgcggaatcgtcgatggcgatacggtacgcgtctggaatcatcgcgggcaggttctggcgggcgcggtcgttaccgacggaattcggcctggcgttatctgtattcacgaaggcgcatggccggaccctgaacctaccgcaggcggcatatgcaaaaacggcgcggtaaacgtcctgacaaaagatcttcccagttcccggctggggaacggttgtgcgggcaacaccgcgctggtctggtttgagaaatataccggcccggcgctaccgcttacggcgtttgatccgcctgccaactcataatccaggtggggtgggaggtatcctcctgccaggcgctatcttcaatacgaaaaccgagcgcatggtagaagtttacggcggattgatttttctggtaaacctcaaggctcagcagaggaaaacgttgctggacatattccagaagcgctttgccaatgccgtgtcttaacgcgtcgggggcgacaaacagcgccccgacaaaacgggcttccagtacgctgacgaagcctttcagttgcccattttcctcccatacccaggtttgcgcggcgggtaaatagacgtcgcgtacaattgcttcgctctcgtgccagtaacgttcttcgataaagggatgggcataaatggtacttttcatccacagcgccagaatagacgccatgtcttcactctgggatttgcgaatcatgtttttctcccggatggcaaaaacagccggtaatatggtcgttgaccagtccgcacgcctgcataaaggagtaacagatagtcgtaccgacaaacttgaaaccgcgttttttcaatgccttagcaagcgcatcggacgcaggtgttgaggtggggatcttatccaggctggccgcctgggtgatctgcggctgaccatcaacgaatgaccagacaaaatcggcgaaagactcgccgttttgctccatcgcaagccaggcgcgggcgttactgataatggcctgaattttaccgcgatgtcgtatgatgcccgtgttctgtagcaggcgttcaacatcctcctcctgcatagctgcgatgcgtatcgggtcaaactgatgaaaacaggcgcggtagttctccctctttttaagcacggtgatccaggataaaccggcctgttgaccttcaagacagatcatttcaaacagctttctgctgtcagtttccggtacgccccactcgttatcatgataggcaatataaagggggtcctggctgacccagtcgcaacgctgcatagacttcctcgttattgtggttaccgcgaaaatttccttcaacccgccttgacgggtccgctaaaaggacaatagttaatacagggctgatgtccgacatccttcattcaatgacaataatatcgccgaattcggctctactctggagtcgcgttgatgattgtaagaaaacgccgtggtcgccggacattgcgttgtctggcgggccttatggcctgctcgttttttatcaataccacgtatgcctggcaacaagaatatatcgctgaagcggctccggggcatacgacggaacgctatacctgggacagcgatcaccaaccgaattacaacgacatactggccgaacgtattcagtctacgcaaaatacggtgggtccggtgcttagcctggcggatgaaaccccgcttgatgcgaccagcggtatcagtatgggctggaatttttcgctttcccgacgcgtaaccactgggccggtcgcggcgctgcattacgacggttcgacgtcatcaatgtataacgaatatggcgatagcgcgacgacattagcgcttaccgatccgttatggcatgccagcgtcagtacgttaggctggcgggtaaactcgcagttcggcgatgtccgtccctgggcgcagatcagctataaccaacagtttggggaaaatatctggaaagcgcagtccgggttgagtcgtatgaccgcaggaaatcaggcgggaaactggctggatgtcaccgtaggcgcggacgtgttacttaacccgcacctggcggcgtatgcggcgttttctcaggcggaaaacagcgctacggatagcgattatttgtataccctgggggtgagcgccaggttttaacgggataaaccgtcgcctggacttattagaagttcagctaataccctatctatatatttacaaaaatatataggtcaatcacattctctatagacactttttgcgcttcctgtggtctacttagccgcgctggtagactttctcacatctgcgttagccgcatatttacctgtttgattaaagaatcgttgtacaggtcgtttttatcccgattcccagggtttgtttgcatgagatacattaaatcgatgacgcagcagaaacttagtttcttgcttgcgctctatatcggtctgtttatgaattgcgccgtgttttaccgccgtttcggcagttatgcgcaagaatttaccatttggaaaggcctttccgcagttgtcgaacttggcgccacggtgctggtcactttcttcttacttcgtcttctttcactgtttggccgacgcgtctggcgcgtgctggccacgctggtggtgctgttttccgctggcgccagttattacatgaccttcctgaacgtggtgattggctacggcattattgcgtctgttatgaccaccgatatcgatctctcgaaagaggtggtggggctgcactttgtattgtggctgattgccgtgagcgtgcttccgctcatctttatctggagtaaccactgtcgctacacgttgttgcgccagctacgtacgccggggcagcgttttcgcagcgccgctgtagtgatactcgcaggcgtaatggtgtgggcgcctatccgcctgctggatgtacagcagaaaaagtttgaacgggcgacaggcatcgacttacccagctatggcggcgtggtggcgaactcctacctgccctcaaactggttatctgcgttagggctgtatgcctgggcgcaggtagatgagtcgtcggacaataattcgttaataaacccggccaggaaatttacctatgttgcgccgaaagatggggatgacacctacgtcgttttcattatcggtgagacgacccgttgggatcacatggggattttcggctacgagcgtaataccacgccgaagctttctttacgctgtatgtttgtacgggaaggtggggcggataataacccgcagcgtacgttaaaagagcagaatgtttttgccgtactcaaacagctcggattcagttccgatctgtacgccatgcagagcgagatgtggttctatagcaataccatggcggataatatctcttaccgcgagcagattggcgccgagccgcgtaaccgcggtaaaacggtggatgacatgctgttgattgatgagatgcagaactcgcttgcccagaatccggagggtaagcatctgattatcctgcataccaagggatcgcattttaactatacgcagcgttatccgcgcagctacgctcaatggaagcccgaatgtattggggtcgatagcggctgcacgaaagcgcagatgatcaactcttacgataactccgtgacctatgttgatcactttattaccagtgtgttcgatcagctacgtgataaaaaagcgattgtgttctacgcggctgaccacggcgagtcgattaacgaacgcgaacatttgcacggtacgccgcgcaatatggcgccgccggagcaattccgtgttccgatgctggtatggatgtcggataaatatcttgccagtccgcaacatgcgcagatgtccgctcacctgaaacagcaggcggagatcaaagtgccgcgtcgtcatgtggaactgtacgatacgataatgggctgcctggggtatacatcgccgaatggcggcattaaccagaacaacaactggtgccatattcccgatgcgcagaaagtcgccgcgaagtaggttgtctgccgactttctcgccgattgaattgtattttgcgactaagggattgacgggcgtgcgcctgagcagtaagatgcgcccgcattcggtgattggcgcagcctggtagcgcacttcgttcgggacgaaggggtcggaggttcgaatcctctatcaccgaccaaattcagaaaccctgctcagcgagcagggttttttgtatctgaagcctgacgaggatgagaacctccgggggcaagaggttcgactcgagcgaagcgagagaacgttgcgtcagcaacggcccgcagtggcaagtcatcctctgtcaccggcaggttgacgctcgcaccaccagttcaggcatgatcccgtcgctgtagctgaccttctcacccgacagaacggcaaacaggagtgtgattgcctgtcgcgccacctcatcaagatgcatattcactgccgtcagcggcggcagcgattcgcgcgcgcggataccgtcatagcgagtaaccacccgtatttgttcaggtatggcgatgtcttgttcctggaaagcccgtaccgcgccgctggcaaaggtatctatcagcaccagcacgccgtcaacgtcgggatgcgcctgtaatagctgctgcgcggcctggtagccggcattttcaccctcgctttcattgagagagtagacgacggggtcctggcgccccgcgcaccagcgctggtaagccgcttcgctctctagaactgatgttcgccgtgtgttaccgacaaataacgcacatttgctggcaccggaggcctccagatgcgttagcagaagctgtgctgttgccgccgagtgcagctcaacccacggcacaggcgtgtcggtccccggcgtgcggccaatggtgacgcagggaatgcccgcttgcgccagcgcctggagctgcgggtcgttctccgccggctcaatcaggatcgccgcgtcaaagctgacggcatccagtggatttacccctggtggcaccagaatcagcgcatgctgtttttccagcgccatcatcgcggacgttaacgccacctccatcataaatcccagtcgtgatgcgccggaggcaatcgccagcggcaccgaagagagcaaagcaatggtattggttttgccggttcgtaactggcgagcgcgaatattcggcgtgtagttgagcgcaacaatggcctcttcaatacgccgtcgcgtctgcggctcgacaaagcgggtgttgtgcaatgcattggataccgtccctggcgagacgcctgcatggcgggcaacatcaatcaactttgcgcgttttttattttgaacagccatctgcttcctgacctgcgaaaatttgcgcacagggtagcatatttaccagacggtaacgtttgctttttttcggtggtgatcgtaaaaaactcttcattaaaacgttttaatggagtattttggcgcaaatctattcctcaggaggcgatgtggcacacttaactcaggattcgactttcacccttggacgccgtccggcgggccttatctacgctgataaggcgaagagctttggcggctatacgctttttgcgccgcaaaccgccgaagggcgggtttacctggtggacgagcagggcgaagtcgcgcatcagtggcagcttccggttcgcgccgggcgtgatgcggtgctgctgccgaacggtaatctgggttataacggcagccaccgcacttcagcgaacctctatccggcgtgggatctctggcacggcggcgacttctacgaagtgacgccggataacgaaatcgtctggcattacgaagatatttaccatcaccatgatgcgcaatggttggcgaacggtaatctgctgtataccgccgcgtcgccgttacctgccgatatcgccgcccgtgttaccggcggcgacccgcgccgcgatgcgccggacggcgtgattcagagcgacgtcgtcaaagaggtcaatcgcgacggtgaagtggtgtgggaatggcgtgcctgggagcatttgaatccggaagatttcccgattcatgatattttcgaccgccgccactggccgatgattaacggcctgtccgtcacccgtgatggcctggtactgatgagcctgcgtaccacttccggcgtcattgccgtggataaagagagcgggaaggttatctggcatgcagggccggaagtggtagcgcagcagcacacgccggttgagatggagaacgggtcgattctggttttcgataacggcaacctgcgtcccggcgtcacctcgccgcattccacggtgctggagttcgatccgcagatcaaagcgattacctggcagtatcgcgatatcttcccgccggcgtttttctcgccgtatatggggagcgcgcagcggctggcgaacggcaacacctttatctgtgaatcggcgtttggccgcctgtttgaagttaccccggaaggcgaaacggtatgggaatatatcattccgttctttaatgaatatccggagcacctcagtaaaggcattattcctggaaaacagaacagcgccttccgtgcgcatcgctatgccgctgatgccattagttggttgaaataatgcagaccgccagcccgcgctggcggttatttttttgatgttttatgggagttaatcatgccgcagcctggccttactacgccggataacgatgcattaccctggcaaaccaccttacttttggcgcttcagcatgtgctggtcgttgccgccacccccattacctccgtctttctgatcgccaaagcgctccactttaccgatacggtgaccgcctcggtacttagcgcgacctttctgatgtgcggtctgggcgctattctgcaaagcctgggtgtgaaaggggtgggcgcgcgtttgccgtttattatggtaccggggggcgcgccgattgcgattttcgttgcgatcgctttacagaccaatatccagaccgcgattggcgccgtaattctgacctcgctgttctactttatcgcgttgctgattttccgccgctgcctgcaccattttcccccctttatcattggcatcatgctgctaatggtgtcgattaaccttattcgcctgtacggcgggttgatcattggccagccagggagcgccgacttcgctcatccaaccagtatcattttatcgctggggactatcctgataacgctgattttcgcgctggcgtttagcggtattttgcgccagctggcggtgatgttcggccttttagcggggacgctgctgggaatggcgctgggcagcaccgattttagcggtgttagtcacgggccgctgtttagtttcccacagcttttgccgttcggctggccgatttttgatctctccgcctcgctgcctttactgatttacgcggtcatctctatggctgaagcaactgggcaaacgattgcgaccgcggaaatagtcaattccacgcaaaatgtgcaacaggcgattccacgtaccattcgtggtgatgcggtaatgtcgctgctggggggatttttggcacctccttaattatcacctccggcgaaaatattggggtgatacgcaccactaacgtgaaatcgcgtttcgtgactgcggctgccggaggattgttaatcctgattgccatattcgcgccgctggtacgtctggcgacctgtctgccaggttcggtggtgtgcggtacggcggtgattgtcttcagcattatcggggttatcggcattgatatgattgcgcgtgagccactgcatacgccgggtaaaacctacgcgctggcgatggggctggccatgggaatgctacctatactggtacccggcctgtatcagaatttcccggcgggcgtacagatggtctttggcaacggcatggcagcggggacgttgacggcgattctggtgaactcgttgtttaactggagcgaaaagcgcacgcaggccagggccaaaagttagtttttgtgatcgcggtaggccgcacgacggcctacttatttacaattttgtaacatattcgatggtgtttttcaatgtccggatcactcttctttgcacacggcttatggataacctcagcattttcgcctgtgcgttttagcgttagtggtattaatcgctcagataatcaacatatcgaaagaaatttttcaattaatggctaattgttaatcactaactgttgcaaaatattaagtgaataactctgcctttctgcctgtagcacaaatttccctgctgaaaatacccttctgaactttttttaatctttgtttgttaattctcaccgttgttgtaaaagctggttacctgtattgacgttttgacattctattgacagattgtagggaatgaggggcattttatggagaatccgcactgcaactcagtcgattatgcgaacggaatccccacctctcactactgacctgaccaggtaaaaaacaaaaaaggccgagcggtaaaagtctttgcaaagggcaaaacaacatacatcacaattggagcagaagaatgagtatttccttgaagaagtcagggatgctgaagcttggtttgagcctggtggccatgaccgttgcagcaagcgtgcaggccaaaaccctggtttattgttcagaaggctcgccggaaggctttaacccacagctctttacgtctggcaccacctatgatgccagctccgtacctatctataaccgtctggttgaattcaaaaccggcaccacggaagtgatcccgggtcttgctgagaagtgggatatcagcgaagacggtaaaacctatacgttccacctacgtaaaggggtgaaatggcaatccagcaaggatttcaaacccacgcgcgagctgaacgccgatgatgtcgtgttctcttttgaccggcagaaaaacgagcagaacccgtaccataaagtgtctggcggcagctatgaatactttgaaggcatggggctgccggatctgattagcgaagtgaagaaggtagacgatcacacggtgcagtttgtgctgacgcgtccggaagcgccgttccttgccgatttagccatggacttcgcctctattctttccaaagaatatgctgacaacatgctgaaagccggtacgccggaaaaagtggatctgaatccggtcggcactggcccattccaactggtgcaatatcagaaagattcccgcattctctacaaagcctttgacggctactggggcacgaagccgaaaattgaccgcctggttttctccattacgcctgacgcctctgtgcgttacgccaaactgcagaagaacgaatgtcaggtgatgccgtatccgaacccggcggatattgcgcgcatgaaagaagataaaaacatcaacctgatggagcaggccggtctgaacgtgggttatctctcctataacgtgcagaaaaaaccgctggatgacgtcaaagttcgccaggcgttgacctatgccgtgaataaagaggccatcatcaaagccgtttatcagggcgcaggcgttgcggcgaaaaacctgatcccgccgacgatgtggggctacaacgacgatattaaagactacggctacgatccggaaaaagcgaaggcgctgctgaaagaagccggtctggaaaaaggcttcaccatcgatctatgggcgatgccggtacagcgtccctataacccgaatgcgcgtcgtatggcggaaatgatccaggcggactgggcgaagattggcgttcaggccaaaattgtcacctatgaatggggcgaatacctcaagcgcgctaaagatggcgagcaccagacggtgatgatgggctggaccggcgataatggcgatccggataacttcttcgccacgctgttcagctgcgatgccgcccagcaaggctccaactattcaaaatggtgctacaagccgtttgaagacctgattcagcctgcgcgtgcgaccgatgaccacaacaagcgtattgaactctataaacaggcccaggttgtgatgcatgaccaggcgccagcgctgatcatcgctcactccacggtttatgagccagtacgtaaagaagttaaaggctatgtggttgacccattaggcaaacatcacttcgaaaacgtctctgtcgaataattaaaagagcgctgcgccccggtgttgtgtaggccggataagcgcagcgccatccggcgtaatgctttatccgcgatgcagtttgcgtgggataagatttgtgagcaatacagactcacggttccaggccgtgcgtcatgagagagaattcgggttatgttgcagttcattctccgacgtttgggactcgttatcccgacgtttatcggtattacccttctcacctttgcctttgtccacatgatccccggcgatccggtgatgatcatggcgggtgagcgaggtatttcccctgagcgtcatgctcaactgctggctgaactcggtcttgataaaccgatgtggcagcagtacctccattatatctggggggtgatgcatggcgatttaggcatctcgctgaaaagccgaatccccgtgtgggacgagttcgtacctcgctttaaagcgacgctggaacttggcgtctgcgccatgatttttgccgtcgccgtggggattccggtgggcgtgctggccgcagtgaagcgcggttctatcttcgatcacactgccgttggcctggcgctgaccggttactctatgcctatcttctggtggggcatgatgctgatcatgctggtctccgtccactggaacctgacgccggtttccgggcgcgtgagcgatatggtgttccttgatgataccaatccgttgacgggctttatgctgatcgacaccgctatctggggcgaagagggtaactttattgatgcgctggcgcatatgatcctgcctgcgatggtgctcggcacaatcccgctggccgtcattgtgcgtatgacccgttcgtcgatgctggaagtgctgggggaggattacatccgtaccgcacgcgccaaagggttgaccaggatgcgcgtcattatcgtccatgctctgcgtaacgccatgctgccagtcgtcaccgtgatcggcctgcaggtcgggacgctgttggctggcgcgattctgacagaaactatcttctcgtggcccggtctggggcgctggctgatcgatgcgctgcaacgccgcgattatccggtagtgcagggcggcgtgttactggtagcgacgatgattattctcgtcaacctgctggtagacctgctgtacggcgtggtgaacccgcgtattcggcataagaagtaaggggccatcatgtcacaggttactgaaaataatgttaatgccgcaccggcgcccatgacgccattgcgggagttctggcactatttcaaacgcaataaaggcgcggtcgtcgggctggcgtatgttctcatcgtgatcctgattgcggtgtttgccaactttattgcgccgtacaacccggcagagcagttccgcgatgcgctgctggcgccgccggtctggcaggaaggcggcagttgggcgcatattctgggaacggatgatgttggtcgcgatgccctctcgcgcctgatgtatggcgcgcgtttgtcgctgctggtcggctgtctggtggtcgtcctgtcgctggtcatggggattattctcggcctagtcgcgggctacttcggcggtctggtcgataacatcatcatgcgcgtggtcgatattatgctggccctgccgagcctgctgctggcgctggtgctggtggcgatcttcggcccctccatcggcaacgctgcgctggcgttgacgtttgtggcgctgccgcactatgtccgcttaacccgcgcggcggttctggtagaggtgaaccgcgattatgtgactgcctcccgcgtggcgggcgcaggcgcgatgcgtcagatgttcgtcaatattttcccgaactgccttgcgccgctgatcgttcaggcatcgctcggtttctctaacgccattctcgatatggccgccctcggctttcttggcatgggcgcgcagccgcctacgccggaatggggcaccatgctctctgatgtattgcagttcgcgcaaagcgcctggtgggtcgtgaccttcccggggctggcgattctgctgacggtactggcatttaacctgatgggtgacggtctgcgtgacgcgctcgatcccaaactgaagcagtaagaggttcgagatggcgttattaaatgtagatcaattatcggtgcacttcggcgacgaagggacaccgttcaaagccgtcgaccgcattagctacagcgtgaagcagggtgaggtggtcggtattgtcggcgagtctggttccggcaaatccgtcagctcgctggcgattatggggcttatcgattacccaggccgcgtgatggcggaaaacctgctctttaacggacaggatctgaagcgcatttccgagaaggaacgtcgcaacctggtgggcgctgaagtggcgatgattttccaggacccgatgaccagcctcaatccttgctataccgttggctttcagattatggaagccatcaaggtacatcagggcgggaacaagaaaacccgtcgtcagcgagcgattgacctgttgaaccaggtgggtattcccgatccggcttctcgtctggatgtctatccgcaccagctttctggcggcatgagtcagcgcgtgatgattgcgatggccatagcctgtcgaccaaagctgttaattgctgatgaaccgaccacggcgctggatgtgaccattcaggcgcaaatcattgagctgctgctggagttgcagcaaaaagagaacatggcgctggtgctgattacccatgacttggcgctggtggcggaagcggcgcacaaaattatcgtcatgtacgccgggcaggtcgtcgaaaccggcgctgcgcaggatattttccgcgcgccgcgtcatccgtatacccaggcattgctacgtgcgttaccagagtttgcgcaagataaagcgcgtctggcgtcgctgccgggcgtggtgccggggaaatatgaccgaccgacgggttgtctgcttaaccctcgctgcccccacgccacggacagatgtcgtgcggaagaacctgctctcaaccaactggacgatggacgtcagtcaaaatgtcattacccactcgatgatgccgggaggcccacactatgagtacgcatgaggccaccttgcaacagccgctgttgcgggctatcgacctgaaaaaacactatccggtgaagaaggggatcttttctccggaacggctggtaaaagcgctggacggcgtgtcgtttaatctcgaacgcggtaaaacgctggcggtagtgggggagtccggttgtggaaaatccacactgggtcgcctgctgacgatggttgaaacgccaaccggcggcgagctttattaccaggggcaggatctgctcaaacacgatccgcacgcgcagaaactgcggcggcagaaaattcagattgtgtttcagaacccctacggttccctgaacccacgcaagaaagtggggcaaattctggaagaaccgttgctgattaacacctcgctcagcaaagagcagcgccgtgaaaaagcgctggcgatgatggcgaaggtggggctgaaaaccgagcactacgaccgctatccgcatatgttctccggcggccagcgtcagcgtatcgctatcgcccgcggtctgatgcttgatccggacgtagtgattgccgacgaaccggtctccgcgctcgacgtgtcggtgcgcgctcaggtgctgaacctgatgatggatttgcaacaggatatggggctgtcttatgtctttatctcgcacgacctgtcggtggtggagcacattgccgatgaagtaatggtcatgtacttaggccgctgcgtggagaaagggaccaaagagcagatttttaacaatccacgtcatccctatacccaagcgttgctctccgccacgccgcggctgaatccggacgatcgccgtgagcggattaagctgaccggcgagttgccgagtccgctgaacccgccgccgggctgcgccttcaacgcccgctgccgccgtcgcttcggaccctgtacgcagttacagccgcagcttaaagagtacgacggccagttggtggcctgctttgccgtcgatcaggatgaaaacccgcagaagccgctgagttaattgcgttttatgccggatggcggctgcgccttatcaagcctacaccttacttgtaggcctggtaagcgtagcgccaccgggcatggctctccggtacgacttagagcctatcccattagggctattttacttgccattttggacttgggcagtgctcgccaaaacgcgttagcgttttgaacgccgctagcggcggcccgaagggcgagcgtagcgagtcaaacctcacatactacgtgtacgctccggtttttgcgcgctgtccgtgtccaaactggctgtgccaataacgcctggtgggataggctcttattcaatcaattttaataacggcgacaggcacaacaatattccatataacagaataagccaggttttcaggccgcgtaatttttccagttgcgctactttataaatcaggaaaaagggaataatacacgcgacaatgccataaagcggactgcctaactggaaaaagaccaatactgagacgcgaaacgaaacccaaataaccagagtaaccacgataaagacacagattccagatgtcagtaacagtgggttgatgtttttgacatccataatgcgactcaacacattcagtacaatacctttaagcgcttcgtgaaaacctaaataaataccaaagaacgcggtaagtacggcaaaaatattgaggatggtagaggtaatgtggatgatctggccagggattacctgagctgccagcgcaagagcggaaatattctgctcgaacgctgataccgcctcttcatgactaatcgaaaaggtaaacgaaaacgagaaaaagagaataatggcaatcagcgtaatatagctaatgcgatgcgtgcgaatcgccatccgggtggccagcacacggtcaggttcgcgcttacgataggcgatgttcattgggtttagcacctgaatgaagaccgcagaaaagaagcaaaatgggatagtgagcagtacgtcgcgaaagaaaaccgatgcggcgggaaaggcggaaatattatcaagattccagtgtgggatcatcgccaaaccgaatatcagaatgatcccgacttttaccactaccatcgggccggaaattttaaataatagcttttccccgccggaggcaatcgccaccagcacggcgaaaatcgcgactttatagataatagactgcgaaagatcggcctcagtaaggccgaaggttttgatataggaggcgctatcaaacaccaccgacagggagtaaataaacaccccgtggataatcataagaaaatagattacaccgagaaaaacgccccagtttttgccaagatagtgactgataatatccgtataatcgtcacaggtttcgctttcagataacgtttttagataaatatcctgcacaatataggtagcgggataggcgatgataaaagcggtaataaatacccagatccccttgagaccgatttgcactggcattaagacggtaccggcgccgattgccataccgatacacaagagcacccagccaaaatcatattttgtaaacggtaatctcgttgaaagcggtgtggtcgtagcgttactgttatttaatggtaatgtgtcgtcctgcatagagccccctgcccaaaatatacgcagctctctcataaagaatgctgcctataaccaggctatagtgccttgatacccgatgcggcaaaccggtgacagcggttcgccgagcaatcgtcagaatgctgcttttctgctggcgcgttcaaggtcatgaataatatcgtcgggatcttcaggtcccgctgaaagacggataagttcgtcggtaatacctgcttttagccattcctctggcgcaacaggcgaatatgtcatagacgcaggatgctgaacgagggtttcggtatcaccgggactggccgcgaggaggcataatttacagaattgagcggctgactgccagcctcagaaatgctgaatgtattctggcaaataaaagtagtcgtctgcgaagcgtcacgcagattgcacgttagcgccgtgccgggacggggattttgccgtaatatcagcagcaagccgggtttacccggtgaggcgcaatgttgcgggggcttgagccccggcggcataggttgctggatagagaaaacccccgcacgttgactggtataaacctggcaacctgacgggggctaacttgaacccaaacactttaaagatagccgcgaacggttgccattgcaacaaggcggctatatgacgcttacgcagttgggcgtggccttctggcacgatctggcggcgccgatcattgctggcattatcgccagtgtgatcgtcaactggctacgtgacaggaagtaacgcgttttgagcgtctgtccgccgtaatggcaacatgcgcccgagccaggccgcaggggaaaccttgcggcctttttcggtttactgcgggtaaggcacccagtcgccgccattcagacgaacgtagggcttaccctggtactgaatcaccaccgcattagcgttttctgaaaccggcgcggtttgcggcagattgctggtcagcttgttccagttcacactgtcttcggtaaagagcttaccgtccacggcgcgtacgaccagttcggaaatcgccaggtagctgctcggctgattaatatcaatcggcgcgccctcatgcggggctttcatgccaaaaaatttcacgcccgccgggacgttggtgatggaggggctgggaatatcgcgcaggcctgagatctgcattctgtcgcccttcagcgcgccgccgtgctccggtacgacgactaccatcaccttacgcccggatttctccagttcggtaaagaaggcgtccagttcatcgaacagtttctgcgcgcggattttataatccgccgttttgctgacgccagggaagtggttgccatcgtgcagcggcagcaggttaaagaaagtcgcggagcgggaattggcttcacgttcttcccctgttaaccagcggttcaggaccgccagatcgtcatataccggcgagccgtcgaatgacagcagggcggttggcaggccggactggttcatcagttcgctctgcataccgccgttttcgcgaacttctttcaggaagccgccaaattcaccgttatgatccatcatcagatgctgagtaaagcccagtttcgccagattatcaaacagataacattcgttattggctggttgataaagtcgggtatgcgaaggttgaccacagctggcgcgcagcagacgaatggccgccgggccgctgtaagacgtaccggaattaaagtgtttaaacaaaatgtcaaagtgcgaccatagcggatgtgacatcaggcctgccgcttcgacatccgaccaggagagcgaacaaatattgatgaccaataggtcgaacggctgcgcatcaggcggaagctgcgccgggaacgtcgttttccgcttttcttccgcggcatagaaggtgttcaaccaggcgttcagattcgcggtcgttggcggcgcggtttgcgcaggcatatcgccgatgaccggcttatcgcccgctgtcgcgacggtagcggccgcgttaccgccagtcgtcgtcaccgtatcggttggctggcctgccggccacagcgtaaaaaccgggccggttaatgtcaggacattcagccataccatgatggcgaccacaaacaccgtaacccgaatccactgtgataaaaatagccaggcaaccagcagtacgaagatggcgccgatcatttgccagttaataaaacgggcgatcagatcgagcagataaccggagctgaattccgccacctgcgtcccctggctcataatgctttgcgggccgggcagccaggtatcatgccagaacagcgcgaagccgacgggaatggcaatccagtggcgcaaccggtgaaggcgatattttggtattggcatgagcagaaacgccatgaataccagattcagtaaaggatgaaaattcagatagcctgcccacagcaggccaaacttgaccagaaaatagaagttccagccggaaagaccgcgccagtattgccagagcggagaaggcattgaaggagtttgagtatgctgagtcattttttgtctgccttgactttcgtagcgcggcgcagagttccggctggttttacataacgaggtttggcaaatagcagccgggtcgtatcactgatacggcgtagcgaatgacgcgccagataccccagcggaaagaaaatcagcgcgcaaaaaagaataatttgcacgatatcgctgatggtcatcatgatgcacgctccgcggtgtcgtcgagcaatcgcaggggttcaggaatacgacgccagatgcggccatcgtgttcggcatttattaccgggtcggcgcgttttgccagcggtagcggcgttccccacagttccggcgacaataagcgcatctgcaccagctcggcgctgatttgtttatcttcgaaccagaccatacgattagagaaaatatcgcctgtcggcaaagggaaaatatggtttaacgcggtatccagatcgttgacccggcagaatgataaaaacagcaccagacggttgccgccgatggtcataatatcgccggttcggcttggtcgacataatgttaacgcctgctcaacccgaatgcccggcaccgggcgcagcgcgaccagaacgcctttcccgtcggcggggagcagggtgttgctcatcatcgtatggatggcatcgcaaaaggtatcccacggctgaaaaccgcgcagtttcaacggttgcgtcatcgacagtagcgtggtgatgtcttccggtacgtaacggctgaactgctgcccctgcacgctttcaataagcgtcagacagcgtgaaagcggggcgttccagggaatgatcatattcgcgccgcagcccagcagcaggcgctcatcggtggcgcgcaaactggcgatattttcgcgcacgacaattttcagcgcgcttccccgctggcgtcgcaaagtatgaatgcgacgagcaagcggttcgatttggttgttctgtgtaagcgaaaaaataattgtcgcggcctgcgccgtgcgcgcgtcgttgaatagcgcttcgttattgtcgaaaagcgtccagtgttccgagagcggcggcgcgccttcaaggacggcgacgtggctaagaatgcgtttttcgtcgctacgcggctgaattgccgtctcctcctgatgggatagcgtccagcgttcgtcctgctgacatagcaataactgctgtcgggcgctgacgcctttttcgttacaccagaaggcaatatcgaacaaatgttggtcgccctgaaaacgtaaactggcgaggccgaaaagtgagcgatactcgcccatcaacaacgaggactgtttatcactattattacaaggggtaataaccaacaatgaacagtgatgaaaacgagtccatttattcattttttccagccatttatgcaggctttctgacgttatattccgccacgtgttatttgcacaaataagaatgaaaaagtaatgcgtcgggttaacagaacaaagcaaatcgtggggcaaagagtatagccctttttctgaatccggcatggtaaataagcggattttctccggaccgtgagattcatctaatttgattactttgccaggatcgccttccatgccgatgacggcgacatttgcattctccgtttgtgacgcaatcgtttgattcaccaggctgatggcatcttgctggcgatcggcgttaacccaccagacgccgccggttggcatatggcgcagttcatcccataatgatgagatgccgagagaaaatacggggtccacagtgtccctcatgtcactattttaactgtttatcagtttactagcgaaagcacagaaataaacctaacattgaaattaaaacgcatcagatttagcatgtgaatcaatttgtccggcaggatgccctgtaactctgcgctttgcatttttacacattataaatgatgtcacggaaagatgaaaaatgcgcgttctcccgtattgacgacggggcgtaatgctgccagtgagaaatatttaaaaaggagcaaccagaatgtataacaatgaacctggcgctcagtccgatccaacgttgggctacacttttcaaaatgattttctggcattaagccaggcgttttcactacccgaaatagattataccgatatttcccaacgcgaacagttggcggcggcgattaaaagatggccgctcctggctgaatttgcgcaaccacattcattaaggaagccatgaatggcgattctgggactgcagggcgtgcgcggcggggtgggaaccacatctctcaccgcagcactcgcctgggcgttacaaatcttaggggaaaatgtcctggtgattgacgccagccccgataacctgctgcgcatgtcgtttaacgtcgacttcgtccatcagggcggttgggcgcgatcgttgctggacggccaggactggcgcgatgccgggttacgttatacctcgcagcttgatctactgccgtttggacagctcacctcgcaagaatgggaaaatccgcaggcctggcaggagacgctgggagagatcggatcggctatccaggcgctgaaagcgagcgggcgttatagctggattttactggacttgccctacggcgagtcaccgctgacacgacagctggtgagcctctgcgaccatacgctggcgatagcccaggttgacgctaactgccatattcgccttcatcagcaggcgttgcctgccggagcgcatattctgatcaatgacttacgcattggcagtcagttacaggacgatctgtaccaggtctggctgcaaagccagcgccggttgctgcctattgtgatccatcgcgatgaagcgatggcggagtgcatggcgtcgaaacagccgttaggcgagtatcgcagcgattcgttagccgccgaagaggtgttaacgctggcgaactggtgcctgctgcacgatgcgggcgacaaaacgtctgccgggagcctgcgatgagcgccctttcccggtggctgcttatcccgccggttagcgcgcgcttgagcgagcgctatcagggttaccgccgccacggcgcgtcgccgtttagcgcagcgctcggctgcctgtggacgattctggcgtggatagtgtttccgcttgagcatccgcgctggcagcgtattcgcgacgggcataaagcgctttatccgcatattaacgccgcccgcccgcgcccgctggacccggcccgttacctcattcagaccctctggctggtgatgatctcgtcgactaaagaacgtcatgaaccgcgctggcggtcatttgcgcgcctgaaggacgttcgtggacgttaccatcaatggatggataccttaccggaacgggtgcgccaaaagacaacgcacctggaaaaggaaaaagagctgggacatcttagcaacggcgcccggcgttttattctgggcgttatcgtgaccttttcactgatactggcgctgatctgtattacgcagccatttaacccgctatcgcaatttatctttctgctgttgctgtggggcgttgcgctgttggtacgacgtatgccgggacgcttttccgcgctgatgctcatcgtgctgtcgctaacggtctcctgtcgttatatctggtggcgctatacctcgacgctaaattgggacgacccggtcagtctggtgtgcggactgattctgctgtttgcggaaacctacgcctggattgtgctggtgctggggtacttccaggtggtgtggccgttaaatcgtcaaccggtgccgttgccgaaagagatgtcgcagtggccgacggtggatatttttgtaccgacctataacgaagaccttaatgtggtcaaaaataccatttacgcttcgcttggcattgactggccgaaggacaagctgaatatctggatccttgatgacggcgggcgcgaatcatttcgtcagtttgcccggcatgttggcgtgcattacattgcccgcgctacgcatgaacacgccaaagccggcaacatcaacaatgcgttaaaacacgcgaaaggcgagtttgtggcgatcttcgattgcgaccatgtaccgacgcgctcgtttctgcaaatgacaatgggctggttcctgaaagagaaacagctggcgatgatgcagacgccgcatcatttcttctccccggacccgtttgagcgcaacctgggacgttttcgtaaaacgcctaacgaaggcacgctgttttacggactggtgcaggacggtaacgatatgtgggatgccactttcttttgcggatcgtgcgcggtgattcgccgtaagccgctggatgagattggcggtatcgccgttgagacggtgacggaagatgcgcatacttcgctccggctgcaccggcgaggttatacctcagcgtatatgcgcattccgcagtcggcggggctggcgacggaaagcctgtcggcgcatatcgggcagcgtattcgttgggcgcggggcatggtgcaaattttccgcctcgataaccctctgtttggtaaaggcttaaaactggcgcagcggctgtgctacctcaacgcgatgttccatttcttgtccggcattccgcgcctgatctttctgaccgcgccgctggcttttctgctgctgcacgcctatatcatttatgcgcctgcgttgatgattgcgctatttgtgataccgcacatggtccacgccagcctgactaactcgaagattcagggcaagtatcgtcactctttctggagtgaaatctatgaaacggtactggcatggtatatcgcaccaccgactctggtcgcgttgatcaatccgcacaaagggaaatttaacgtcacggcgaaaggcggactggtggaagagaagtacgtcgactgggtaatctcgcgtccgtatatcttccttgtcttgcttaacctgctcggcgtggcggcgggcgtatggcgatactattatgggccggaaaatgaaacgctgaccgtcatcgttagcctggtgtgggtcttctataacctggtcattctcggcggcgcggttgcggtttcggtagagagtaaacaggtcaggcgcgcgcatcgggtcgagattgccatgccgggggccatcgcccgcgaagatggacatttgttctcctgtaccgtacatgacttctccgacggcgggttaggcatcaagatcaacggtcaggcgcaggtgctggaagggcagaaagtgaatctgttgcttaaacgcgggcagcaggaatatgtctttccaacgcaggtagtgcgcgtaacgggcaatgaggtcgggctgcaactgatgccgctcaccaccaaacaacatattgattttgtgcagtgtaccttcgctcgcgccgatacgtgggcgctttggcaagatagcttcccggaagataaaccgctggaaagcttgctggatattctgaagctgggcttccgcggatatcgccacctcgcggagttcgcgccgccttcagtaaaagtaattttccgatcgttgacggcgttaattgcctggattgtatcgtttattccgcgtcgcccggagcggcaagcggcgatacagccgtcggatcgggttatggctcaggctcaacaatgatgataatgcgatgaaaagaaaattgtcctggatgtgtgcggcggtaataggattaagcgcgtttcctgctttcatgacggcggcggcgcctgcgatgccgccattgatcaatgctgaacccaccgagcctgcgcagtcgcccgtaactgaggcgcccgtcgtggcgcagaccgcgccttcgcgcgaggtcaagctgacctttgcgcaaatcgcgccgccgccgggcagtatggcgctgcgtggcgttaaccctaacggcggcattgaatttggtatgcgcagcgatgaagtggcgtcgaaagcggtgttgaatctggaatatacgccctcgccgtcgctcctgccggttcagtcgcagctcaaggtttatctcaatgatgaactgatgggcgtactgccggtgacaaaagagcagttggggaaaaagacgctggcgcaggtacctatcaatccgctatttatcaccgactttaaccgggtgcggctggagtttgtcggccactatcgcgacgtgtgtgaaaacccggccagcagtactctgtggttagacatcgggcgaaatagcgccctggatctgacctataacatgctggcggtgaataacgatctgtcccacttcccggtgccgtttttcgatccgcgggataaccgtccggtgacgttgccgatagtgtttgctgacatgccggatctggcgcagcagcaggcggcttctattgtcgcgtcctggtttggctcgcgggcgggctggcgcggtcagcgcttcccggtgttgtataatcacctgccggatcgcaatgcgatcgtgttcgccaccaacgatcgacgccccgatttcctgcgcgatcatcctgcggttaacgcgccggttatcgagatgatgaaccatccggataatccgtatgtgaagttgctggtcgtgtttggtcgagatgataaagacctgttgcaggcggcaaaaggtatcgcgcaagggaatattctcttccgtggttccagcgtggtggtcaacgatgtaaaaccgctgctggcgcgcaaaccgtatgatgcgccgaactgggtgcgtaccgatcgcccggtcacttttggcgagctgaaaacctatgaagagcagctccagtcgagtgggctggagccggcgcccatcaacgtttctttgaatctgccgccggacctctatttgctgcgtagcaacggtattgatatggatctcaactatcgttatacctcgccgccgaccaaagacagttcgcggctggatatcagtctgaataaccagttcttgcaagcctttagccttaacagcacgcaggaaactaatcgactcctgttgcgcctgccggtacttcagggactgctggatggtaaaacggatgtgtctattccggcgctcaaactgggggcgatgaaccaactacgttttgatttccgctacatgaatccgatgccgggcgggtcggtggacaactgtattactttccagccagtaccgaatcatgtggtgataggggatgactccactatcgatttttcgaaatattaccactttatcgcgatgccggatttacgcgcgttcgccaatgcgggtttcccgttcagccggatggccgacctgtctgacacgctggcggtgatgccgaagaccccaaccgaagcgcaaatggaaacgctgctgaatacggtcggcgccattggcgggcagaccggtttcccggcaattaatctgacaatcaccgatgatagcgctcagatagccgacaaagacgccgatctgctgattattggcgctattccgggcaagctaaaagacgataagcgtatcgatctgttggtgcaggcgacacaaagctgggtaaaaaccccgatgcggcagaccgctttcccgtcgattatgccggatgaggccgatcgcgcggcggatgcgcagtccaccgtcaccgccagcggcccgatggcggcggtggtgggcttccagtcgccgtttaatgatcagcgcagcgtgattgctctgctggctgacagcccgcgcggttaccagctactgaacgacgccgtgaacgacagcggtaaacgcgccgcgatgtttggttccgtggcggtgatccgcgagtccggcgttcacagtctgcgcgttggcgatatctattacgtcggacatctgccgtggtttgagcggctgtggtatgcgctggcgaatcacccggtgctgctggcggtactggcggccctcagtgtggtattactggcgtgggtattgtggcgtctgctacgtattctcagtcgccgtcgtctcgaccctgaccatgagtaacgcatgatgactatgctgcgcggatggataacgatgatcgtcatgctgacggcaataaatgcgcaggcagcgtgtagctggcctgcgtgggaacagttcaagaaagattacattagccagcagggacgcgttatcgatccgggcgatgcgcgaaaaattaccacctccgaagggcagagctacgccatgttctttgccctggcggcgaacgatcgaccggcgttcgcgcaactgtttaactggacgcaaaacaatctggcgcagggatcgctgcgtgaacatctgcccgcctggctgtggggacaaaaagatcccgacacctggtcggtgctggacagcaactccgcgtccgacggcgatatctggatggcatggtcgctgctggaggccggtcgcctgtggaaagagacgcgttataccgaggtgggcacggcgttgctaaaacgcatcgcccgcgaagaggtcgtgaatgtgccggggctgggctcaatgctgctacctggcaaaatcggctttgccgaggcgaatagctggcgttttaacccaagctatctgccgccgcagttggcgcaatactttagccgttttggcgcgccgtggtcgacgctacgggaaaccaatttgcggcttttgttggaaacctcgccgaaaggtttctcgccggactgggtgcgttatgaaagcaagcaaggctggcagttgaaagcggaaaagacgctgatcagtagctacgatgcgattcgcgtctatttatggacgggaatgatgcatgatggcgatccgcaaaaagcgcgtttactggcgcgatttaaaccgatggcgacgttaacgatgaaaaacggcgttccaccggagaaagtggatgtcgtcagcgggaatgcgcaagggacggggccggtcgggttttccgccgctttactgcctttcctgcaaaatcgcggcgcccaggccgtgcagcgacagcgggtcgcagaccattttcctggcagcgatgcctattacaactatgtgctgactctctttggacaaggctgggatcagcaccgttttcgcttcaccgtcaaaggtgaattattacctgactggggccaggaatgcgtaagttcacgttaagtctcatgcacgcttttttgctggctggcggtcgaaatgccttacctggcaaaaggggcgtttctcgggcattgttggggttatcgcttggtatggcgctaacaccgcttgccggcgcagcgacctccgcgcagcaacagttgctggagcaggtgcggctgggcgaggccacgcaccgtgaggacttagtccgtcagtcgctctatcgcctggagctgatcgaccccaatgatccacaggttatcgccgcccgtttccgctatctgttgcgccagggggatagcgacggggcgcagaagctacttgatcggctggcgcaactggcgccggagtcgacggcgtatcaatcttcccgcaccgcgatgctgctctccacgccgcaaggacgccagtctttgcaggaggcgcgtttactggcgacgaccggtcatactgaacaagcgatcgccagctacgacaagctgtttaaaggttatccgccggagggcgaactggcggtcgaatactggacgaccgtggcgaaattgcccgcccgccgtcacgaagcgattaaccagctacagaaaatcaatgccgtcagtccgggtaataacgctctgcaaaatgcgctggcgcaactgttgttcgccagcgggcggcgcgatgagggattcgcggtgctaaaacagatggcgaaatccagtacgggacgcagcgcggcctccgccatctggtaccagcagataaaagatctcccggttagcgacgccagcgtaaaagcgttgcaagactatctgacgcagtttagcgaaggcgatagcgtgtctgccgcccgcgcccagcttagcgagcagcaaaaacagttagccgatccggcgtttcgcgcgcgctcgcagggcatcgcggcggttaatgccggagaaggcggcaacgctattgcgcaatcgcagcaggcggtgagcgcccggcaggacgacagcgaggcggtcggcgcgctggggcaggcatactcacagcgtggcgatcgcgcccgcgccgtcgcgcagtttgaaaaggcgctggcgatggcgccgcacagcagcagccgcgataagtgggagagcctgctgaaggtcaatcgctactggctgttaattcagcagggcgacgcggccttaaaagcgaataatctggctcaggcggagcgtttctatcagcaggcgcgagcagtggataacaccgacagctacgcggtgctggggctgggggatgtggcgatggcgcgcaaagataatgccgccgccgaacgttattatcagcagacgctgcgtatggacagcggtaataccaatgctgtacgcgggctggcgaatctttatcgttagcagtcgccgcaaaaagccgccgcgtttatcgcttctctttccgccagccagcggcgcagtatcgacgatatcgaacgcagtctggaaaatgaccgtctggcgcagcaggcggaaacgctggaaagcgagggcaaatgggcgcaggccgcagaactgcaccgccgccggctggcattagatccggggagcgtgtgggtaacgtatcgactgtcacgcgatctgtggcaggccggacagcacgcccaggccgatgcgcaaatgcgctctctggcgcagcagaagccaaacgatccggaacaggtctatgcttatgggctttatctttccggcagcgatcggggccgggcggcgctggcgcatctcaataccctgccgaccagccagtggaacagcaatattcaggaactggcgggccgattgtaaagtaaccaggtgctggaaagcgctaaccgcttgcgcgatagcggcaaagaacgcgaagcggaagcgttgttacgtcagcagccgccctctacgcgcattgcgttaacgttggcggactgggcgcagcagcgtggcgataatgcggcggcccgcgccgcttatgacgccgttctggcgcgggaaccgggtaatgtcgatgccatgctggggcgggtggaaatcgacatcgcacagggcgataacgctgcggcgcgcgctcaactggcggcgctgcctgcgtcgcaaatcacctctattaacatgcagcgccgcgtcgcgctggcgcagctccagcttggcgatatcacggcggcggcgcggatctttaaccgcattacgccgcaggcaaaagcacagccgccatcaatggaaagcgcgatggtattgcgtgacgccgccgcttttcaggcgcaaacgggcgagccgcagcgggcgctggagacctacaaagaggcaatggtcgccgcggcgattacgccggttcgcccccaggataacgatacctttacccgcctgacgcgcaatgatgaaaaagatgactggctaaaacgcggcgtgcgtagcgatgcggcggagttgtaccgtcagcaggatctcaatgtcacgttggcgcacgattattgggggtcgagcgggactggcggctactccgatctgaaggcgcataccacgatgcttcaggtggatgcgccctggtcggacggacgggcgttctttcgtactgatatggtgaatatggatgttggtcgcttctctacggatgcagatgggaaatacgataataactggggtacctgtacgctggagaaatgcagcggacatcgtagccaggccgatacgggcgcgagcgtggcggtcggctggcagaatgagacctggcgctgggatatcggcacgacgccgatgggctttaatgtcgttgatgtggtcggcggcgtcagctatagcgacgatatcgggccgttgggttataccctgaacgcgcatcgtcgcccgatctccagctcgctgctggcgtttggcgggcaaaaggacgccagcagcaataccggcaccaaatggggcggcgtgcgggccaacggcggcggcgtcagtctcagctatgataaaggcgaagcaaacggtgtctgggcgtcgctcagcggcgaccagttgagcggtaaaaatgtggaagataactggcgcgtgcgctggatgaccggttattactataaggtgattaacgagaataaccgccgcgttaccgtcgggctgaataacatgatctggcattacgacaaagatctgagcggttattcactgggtcagggcggttattatagcccgcaggaatacctgtcgtttgcggtgccggtgatgtggcggcagcgtacggaaaactggtcgtgggagttaggcggctcggtatcctggtcgcactcccggcaaccgtaccatgccgcgttatccgctgatgaatttgattccggcggattatcaggaggatgcgcgtgaccagaccaacggcggcggcagcagtcagggatttggctataccgcgcgggcgctcattgaacgccgggtcactgccaactggtttgtgggtacggctgtcgatatttagcaggcgaaagattatacccccagtcatctgctgctgtatgtccgttattccgcggcaggctggcagggggatatggatttaccgccgcagcctctggtgccttacgctgactggtaatcattgcgtcaggcctacgtattgacaggcgtcgtaggcctgagaagcgcagcgccatcagacgctatcattaaccgttattcagaaaagtccttttcagatacagcctctcttaatgccgctgcaatcgggtatactcaggcggcagtccgggatatccagggagagtcaatttgcgcgtcagccgctcgttaacaattaaacagatggcaatggttgcggccgttgtcatggtgtttgtttttgtcttttgcaccgttttgttgttccatctggtacagcagaaccgctacaacacggctacgcaactggaaagcatcgcgcgctctgttcgggaacctctttcttccgcgattttaaaagcggatctccccggcgcggaaaccattctggaaagtattaaacctgcgggcgtggtgagtcgcgccgatgtggtattgccgaatcagttccaggcgttgcgtaagcgcttcattcctgaacgccccgtcccggttatggtgacgcgtctcttcgaactgccggtacaaatttctttgccggtttattcgctggagcgtcccgccaatccgcaaccgctggcctaccttgtattgcaggcggattcgtaccgtatgtacaagttcgtcatgagcgcgctctctacgttagtgaccatttacttacttttatcgctgatcctgacggtggccatcgcctggtgcgtaaaccgcctgattgtgcatccgctgcgcaaaatcgcccgcgagctgaacgacattccgcagcaggagctgatcggacatcagctggcgttgccgcgtctgcatcaggatgatgaaattgggatgctggtgcgcagctataacctcaaccagcagcttatgcagcgtcaacgcgaggagcaaacggacaacgcgatgcgttttccggtttccgagttgcccaataaagcctttttaatggcgctgctggaacaggttatcacccgccaacagaccaccgcgcttatcatcgtgacgtgcgaaacgttgcgtgacacggcaggcgtgctgcaagaaacgcagcgggagattctattactgacgctggttgagaagctgaagtcggtgctggcgccgcgcatggtgcttacgcaggtcagcgggtatgactttgccattatcgcccacggcgtcaaagagccgtggcacgccatcacattaggtcagcaaatactcactatcattaatgaacgactgcccatccagggtattcaactgcgcccaagctgcagtattggcattgcgatgtattatggcgatctgaccgccgaagcgctctatggtcgcgccgtctccgccgcgtttaccgcgcgccgaaaaggtaaaaatcagatccagttctttgacccggcgcagatggaggccgctcaacagcgccttaccgaagagagcgatatccttaccgcgctggataaccatcagtttgccatttggctgcagccgcaggtcgagatgcgcagcggcaacgtattaagcgccgaagccttgttacgtatgcagcagccggacggtagctgggaattgccggaggggctgattgagcgcattgaatcctgcggcctgatggtcacggtgggccattgggtgctggaagagtcctgccgccagcttgccgcctggcaggagcgcggcgtgacattgccgctctccgtcaatctttccgcgttacagctcatgcaccctggcatggtgtcggatctgctggaattgttaaaccgctatcgtattcaaccgggtacgctgattcttgaggtcactgaaagccgccgtatcgacgatccgcacgctgccgtcgctatcttacgtccgttacgtaatgctggcgtgcgtatcgcactggatgattttggcatgggttacgcggggctgcgccagttacagcatatgaagtcgctaccggtcgatatccttaaaattgataaaatgtttgtcgatgggttaccggatgatcacagtatggtgacggcgattatcctgatggcccgcagtcttaatttacaattgattgccgagggcgtggaggacgaggcgcaacgcgcgtggcttggaacaggcgggagtcaacgtcgcgcaaggcttcctgtttgctcggcccgttcccgcggatatctttgaagaacggtatctgtcgcacgaaaatcctgattacaaaagttaaaaaaggtcgcgcttgtgcgagtcagctcaaactttttaacatttttgtttcaattatgatcctggcgcatttctgtcatgttgtgtgggtgttattttaaggccgcaggttactcataaccttacaagacctgtggtttttacttcaaggacaccctatgaaaacctctctgttcaaaagtctttattttcaggtcctgacagcaatcgccattggtattctccttggccattactatcctgaactgggcgcacaaatgaaaccgcttggcgacgcgttcgttaagctcattaagatgatcatcgctcctgtcattttctgtactgtcgtgacgggcatcgcaggcatggaaagcatgaaagcggtggggcgtaccggcgcggtcgcgctgctttactttgaaattgtcagtacgattgcgctgattaacggtcttatcatcgtcaacgttgtgcaacctggcgccgggatgaacgtcgatccggcaacgctggatgcgcaggcggtggccgtttatgccgcacaagccaaggagcagggcattattgccttcctgatggatgtcataccgggcagcgtgatcggcgcgtttgccagcggcaacattctgcaggtcttactgtttgcggtgttgtttggttttgcgctgcaccgtttgggcagcaaaggccagctcattttcaatgtgattgagagtttttcgcaggtcattttcggcatcatcaatatgatcatgcgcctggcgccgattggcgcattcggcgcgatggccttcaccatcggtaaatacggcgtcggttctctggtgcaactggggcagctcattatctgcttctatatcacctgtattctcttcgtggtggtggtgctggggacgattgcacgggtaacgggctttagcatttttaaatttattcgctatatccgggaagaattactcattgtgctcggcacctcctcttccgagtcagcgttgccgcgtatgctcgataagatggaaaaactggggtgccgtaaatcggtggtggggctggtgatcccgacggggtattcgttcaaccttgatggcacctctatctacctgacgatggcggcggtgtttatcgcccaggcgaccaacagccatatggatatcttccaccagatcacgttgctggtcgtgctgctgctatcgtcaaaaggcgccgcgggcgtgaccggaagcggctttatcgtgctggcggccactatctccgccgtaggtcatttgccggtggcgggactggcgttaatcctcggtatcgaccgctttatgtccgaagcgcgcgcgctgactaacctggtgggtaacggcgtggcgacggtggtggttgccaaatgggtgaaagagttagatcaccaaaagctggacgatgtgcttaataatcgtgcgccggatggcaaaacgcacgaaatttcctcctaatctcgccacttatgcccgtagtcccttccaggactgcgggtgtttgcgcataattgacccctgcgcccaaagcatacagcatgatgcttagggattatttcacttcttccgtgacatttttaggttctcgcggtctaacacgaagtgtttttacgtcatattcaggcatccctgccggggctgtctttttattaccaggattgttgatcaggggttcacatgcagggcacaaaaattcgactcttagcgggcagtctgttgatgttggcctctgccggctatgtgcaggcagatgcgctccagcccgatccggcatggcaacaggggacgctggctaatgggttacagtggcaagtgttggctacgcctcagcgccccagcgatcgtattgaagttcgtctacaggttaataccggttcgctcaccgaaagtacgcaacagagcgggtttagccatgcgattccccgtatcgcgctgacgcaaagcggtggtctggatgccgcacaggcacgttctttatggcagcaaggatttgatccgaaacgtcccatgccgcccgttattgtttcttatgattccacgctctatagcctcagtttacccaataaccgtaacgatctgctgaaagaagcgctgacctatctggctaacgtctccggtaaattaaccattacgccagagacggtgaatcatgcgttaagcagcgaagatatggttgcgacgtggccagcagatactaaagagggctggtggcgttatcggctgaaaggatcggcgttattggggcacgatcccgcggaaccgttaaagcagccggtagacgcagccaaaattcaggctttctatgaaaaatggtacaccccggatgccatgacgctgattgttgtcggcaacattgatgcgcgctccgtcgccgagcagatcaataaaacgttcggtacgctgaaaggtaaacgcgaaacgcccgccccggtgccgacgctttcgccgctgcgggcggaatcagtgagcattatgaccgatgcggtgcgccaggatcgtctctccattatgtgggatacgccgtggcaaccgattcgcgagtcggcggcgctgttgcgctactggcaggcggatctggcgcgcgaagcgctgttctggcatatccagcaagagcttactaaaaataacgcgaaagatattggtctggggtttgactgccgggttctgttcctgcgcgcgcagtgcgccatcaacattgaatcacctaatgataagctcaataccaatttgagcctggtggcgaatgaactggcgaaagtacgcgataaaggtttgtcggaagaggagtttactgcgctggtggcgcagaaaaatctcgaattgcaaaagctattcgcgacctacgcgcgtaccgatactgacattttgactggacagcgtatgcgctcgctgcagaatcaggtggtggatatcgcgccggagcagtatcagaagctgcgtcagaatttcctcaacagcctgaccgtcgatatgctcaatcagaatctacgtcagcagctatcgcaggagatggcattaattttgctgcaaccgcaaggcgagccggaatttaatatgaaggcgttaaaggcgacgtgggatgaaatcatggttccggcaactgccgccgctgttgaagcagatgaggcgcatccggaagtgacggaaacaccggcggcacagtaagcggccgcctgtcggcccggtaagcgcagcgccaccgggcaagaacgaatgacttactgcggcatcgcgtcgtgcggaataatggccccacggtactgaatcaccgtgctggccgtcaggtgtccgcgcttcgcggcatccgtcgcgctgccgcccgtcaaacgaacggccagataaccggcgctgaaggagtcgcctgcggcagtggtgtctatcactttctctttcggcagttttactgccggaacgtcaatgagcgcctcgccctgaatcgagaccaggcaagagtccgccccgcgttttaccaccacttcctgtacgcctgccgcatgggtgcgagcaatgacctcttccaccggttgcttaccccatagcgcgtcttcatcgtccagtgtcaggaaggcgatatcagtacattccagcatcttttgatagacctgctgcgtttcttcgcgacttgtccataaacgcgggcgatagttattatcaaaaatgactttcccgccgttggcccggcattcacgcaataaagacagcagcttatcacggctggtcgggcttaaaatcgcgaggctaatgccgctcaggtagagataatcgaaggtcgccagcgtctcgcagatagccgctgactgctcgctctccagccagaatttcgctgccgcttcgttacgccagtagtagaaggtacgctcgccagtgtcatcggtttcgatgtaatagaggcctggcaggcgattttccatccgctgcgttagcgaggtatccacattttcatgctgccacgcctccagcatctgttggctgaaactgtcggtacccagcgccgttacatagtgaacggccagagcggcagaatcgacctgacgggcaatataaacggaggtattcagcgtgtcgccgccgaagccgcgctgaacatcagcgcctttctgcgacagctcaatcatgcattcgccaatcacggcaatctttttagacatagtcgtgaacctgatctgtaaaaattagcgttagtgtgcgctgtggatgtttagcggtcaataatattaaaacatcggtccattatttttttgagcaagtgcgtatttttgacaagtttcgtggtctgtttttattttgccagggaccgagggtaaagttctctgcctgaacgccgataacctttgacgagtccggactgtcacactcccattaacaggacaactgagatgataaagcaggttatccagcagctacgcgttcctgatgcaggtatagagaatttgcaggaacggcgctattggctgcaatgcgagcgtgcctatacttaccagccgatataccagacggatggccgtctgatgacggttgaacttctcactgccgtcacccatcctgataacccttccagacgtattgccccggatcgttatttcgcggaattagcggttcgacaccgcattgacgtagtaaaagaacaacttcatcagcttgaacaaaaagcggattttttcactcgccatcgcttattggcatcagtcaatgtcgacggccctacgctgattgccatgcgacaacagccggacattctggcagcgatggagcgcttaccctggctgcgttttgaactggtggaacatattcgtttgccgaaagactcctctttcgcctcgatgtgtgagttcgtcccgctgtggctggatgattttggtactggtatggccaatttttcagcgctgagcgaagtgcgttatgactacattaaagtggcgcgcgagctgttcgtcatgctgcgccagtccccggaggggcgcaacctgttcattctgctgctgcaactgatgaaccgctactgccgcggcgttattgtcgaaggcgtggagactctggaagagtggcgtgatgtgcagcgttcgcccgcctttgccgcccagggctattttctttctcgacccgtgccgctgatatcgctcgaagaggtgattctgaccctgtaacgccagactgttcccgtaatacgtggtattacgaggtgcggtcatcctcctttttcgtctggctgaactatctttaggacaggcaagggaagaagtgaggaaataacacatgactaaagcaggcaaaataaccgccgccatcacagggactttcttgttgttgatcgccatagtgattttgttgatcgcaacatttgactggaaccgcctcaaaccgaccatcaaccagaaagtctctaccgaattgaaccggcctttcgctattcgcggcgatttaggcgtggtgtgggaacgccaaaaacaggagtccggctggcgaagctgggtaccgtggccgcatgttcacgcggaagacgtcattctcggcaatccgccggatattccggaagtcacgatggtgcatctgccacgcgttgaggcgacgcttgccccgctggcgctcctgaccaaaaccgtctggctgccgtggatcaaactggtgaaacccgacgcgcgtcttattcgtctgtccgagaaaaccaataactggacctttaacctcgcgcaagacaagaatacggaccccaatgctaaaccttccgcctggtccttccggctggataatattctcttcgaccaggggcgaatcgcgatcgatgataaggtcagtaaagcggatatcactattctggtcgatccgttaggcaaaccgttgccgttcagcgaagtgacgggaacgaaaggcaaagcagacaaatccaccgtgggcgactatgtcttcggcctgaaggcgcaggggcgttataacggggaaccgttgaccggtacgggcaaaataggcggtatgctggcgctacgtagcgaaagtacgccttttcctgtgcaggccgatttccgctctggcaatacgcgggtggcttttagcggcgtggtgaacgagccgatgaaaatgggcggcgtcgatctgcggcttaaattctctggcgattcactgggcgatttatatgatttaaccggcgtgctgctgccggatacgccgccgtttgagaccgatgggcgattggtagcgaaaattgacgccgaaaagtcatcggtatttaattatcgcggttttaacgggcgcattggcgacagtgatatccacggcaccttcacttataccaccggtaaaccgagccccaaactggaaggcgatgtcgaatcgcgccagttacgcctggccgatcttgggccgctgattggcgtggattccgggaaagacgctgagcagtcgaaacggtctgaacagcgcaaaggcgagaagaatgttcagccggcggataaagtgttgccttacgatcgctttgaaaccgacaaatgggacgtcatggacgccgatgtccggtttaaaggccggcgtattgagcatggcggcagtctaccgattagcgatctttcgacccatatcatcctgaaaaacgccgacttacgtctacagccgctgaagtttggtctggcaggcggcagtattgtctccaacatccatctggaaggggataaaaagccgatgcaggggcgggcggatatacaggcgcgtcggctgaagcttaaagaactgatgccggatgtggagctgatgcagaaaacgctgggcgagctgaacggcgatgcggatattcgcggcacgggcaattcggtcgccgcgctgcttggcaacagtaacggcaatctcaaattattgatgaatgatggattgattagccgcaacctgatggaaatcgtggggctgaacgtcggcaactatattatcgggcagatttttggcgatgacgaagtgcgggttaactgcgcggcggcgaatctcaatattgcgaacggcgtggcgcgaccgcaaatttttgcttttgatacagaaaatgcgttgattaacgtgaccggtacggcgagcttcgcctctgaacagctcgatttaaccattgatccggaaagtaaggggattcgtattattacgctgcgatcgccgctttacgtgcgcgggacatttaaaaatccgcaggcgggcgtcaagcccggcccgctgattgcgcgcggcgcggttgcggcagcgctggcgacgttggtaacgcccgccgccgcgctattagcgctcatttcgccctctgagggcgaagccaatcagtgccggacgattttaacgcagatgaagcagtaacgtgaaacgtcgcgccggatgacgccatccggcgccctattacaacgcctgatgacgcgtctcatgggttaacagcagtgcaatcagcgtcagcgccgccattgacgccaggtaaacccctaccgccgccagcccgtagtggctttgcagccatgcggcaatatacggcgcgacggaagcgcccagaatcgatgacacattgtaggaaaacgatgcgccggtatagcgtacttccgtcggaaatagctccggcagcagcgctcccattgggccgaaggtcagccccatcaggctcagacctaacaacaggaacacgaataccagcgctggattgcctgaacccagcagcggggtaaaggcgaacaacgcgaagagaatgatgagcgtggtaatgatgaccatgcttttccgacggccaaatgcgtccgccagcaggccggcgacgggcaccatcacgccgaaaccaatcaccgccatcatcagcatccacagtatttcattgcgcggcaagccaagccccaccggcgcggcggcagtgctgtaagtcatggaatagacggtcatgatatagaacagcgtgtaggtcgccagcatgataaacgtgccgagaatggttacgtggacatgcttcgtcagcaacgtgcccagcggtatttttacctgctttttcgctgcggcgactttcgcaaacaccggcgtttcatgcagcgacacgcgcacatacaggccgataatcaccagtaccgccgagaagataaacggcacgcgccagccccagctcataaattgctcgtcggtcagtagccaggagagcaacgggaaggtgccattggcaaaaaagaagccgatcggcgcgcccaactgcgggaaggagccatacagcgcgcgtttgcgcggcggcgcattctccgtcgctaataacgctgcgccgccccattcgccgcccagccccagtccctgaccgaaacgcgccagcgccagcagcagcggcgcgaaaatacctatcgtcgcgtagcccggtaacagaccgataatgaccgtggagatccccatcgtcagcagcgaagccaccagcgtgactttgcggcctacccggtcgccgaagtgaccaaatagcgcagagccgatcggacgcgccacaaacgcgatagcgaaggtggcgagcgattgtagcgttgccgcagtgggatcgccctgggggaagaagataagggggaacacgatcaccgctgcggtggcgtaaatatagaagtcgaagaactcaatcgcggtgccgataagcgaggcaataacgactttattgcgtgagtttaccggaacatgttcctgctcatggtcgagtgttgtggcggttgcttgcatactattttcttatttttagcgaacgaatagccatattacgcacagcaaaagttatatttcaatgtgtaacaaaagccaaaaatggtcaaaaaaagcgcaaaaaggggataatgtttaagccagctattttgcgtctatgaaatgcttcacataattttaggattggtggataaaactggtttctggttaaataaaagttaattaccggattgatatgctgaaacaatgagatgaggcggaaggacgtgcctgattgtaccgccgggtacgctttacatacctggcctgggtccatacagcagtaggccgaatgacgacgccgtgcgtgccattcggcagcaagccgcagactagcgttgcgttttacccggcattcgcgggtcgtccttatattcggcggtggctatccaggccgcgcagaataacgtcaggcgggcaaaaaagtagaagaatgccatcagaccgagtacggagccaaacgccgcgccggaaggcgatttcaccagtgacggcagcgtataagtcataatgattttaatcacctcaaaaccgatagcggcgataaatgtcccgcgaatcaacgcttttttacggggacgatggcgaggcagtcgccagaaaatccagaagaaaagcagatagttggcaaaaatagagatggccagaccgatcaaatgccaggccggttttaaccattcgatgctgtcgagatacaaggcggagatgatcatctgctgggcggaaccggcgatggaagtaatggacagcgtaatgattaaagcgattaataatccaatcagcgagataaaatcgcgcagatatttgagccagattttctcctgatcctgcggcttgcgctcccagacgtcccgtgactgggcgcgaatcgcttcccgcaggttgcccatccagttaacgccggaatagagcgcgatacccagtccgaccagccctaccgtggtacgctgttgaaccgccgtattaatcgtatttttaagcgtggacgccagcgtaggatcgctcacattcatcaatatcttgctgaaaatatcttccagtagattagggtgcgaggcgaggataaaacctgccgcggcaaaggacaccatcattatcgggatcatcgacagaaacgaaaagtaggtgatagccgcgccaaactgattacccagtcgatcgttaaaacgttcggtcgcgcgaatgaggtgggccaccatcggttgacgctgtattttttgcatcagggtggtgacggaatgcaacgcctgatttgccttttcgtttttttccggggcgtcatgcggctgcgtttctattttttgtatcgggtcgtgctccagttcctgaatagggcgttttacgtcattttcctgcgtcatcaggtcggtagtccttcatcattaatagaatatgtcagtatagcttctccccggtggatgctgaaaatgcggctactctgcggcctctttaatggtttcagtcagccataccataaacaggtgtacccggcgggaaagattacggcgatggggataatgcagcgtcaccggcagtggagcggcgcgatattgcggtaaaatttcaatgagcgctccggcgcgtaacgcctcccgtacagcaatgcgcggcgtctgaatgatccctaatcctgccagacaggccgtatgccaggtctccgtactgtttaccgttagcattccgccggtttttacccactgcataccgtggggagtttcgaaggcaaaacccggtgaagagactcccggggtcaatgaataatgcaccatcgcatgtgaggcgaggtcgtcaaggttttctggatatccaaagcgcgccaggtattgtgggctggcgcagttcacccttcttagtttgccaagcgggcgcgtcagtatccctggcgcatgtagcggctctgtgcgcaccacacagtcgaaatcttcccgtagtaaatcgacctgtcgatcgctactacaaagttccagcgcaatgccgggatactgatgcaaaaaagtgagcaggcgcggcatgataaggctgtttgcgagacctggcgggatatctacccgtattttgccgctgatactggcgggatcaggctggaaaagaccctccagttcatccaggttactcaacagatcttttgcccgttcgtagtaaaccatcccgtcctgagtaagctgtacccgccgggtggtgcggtggagcaggcggatgcccagttgatgttctaacgcttgtatttgccgtgagacgctgcctttgggaaggccgatatcttctgctgcgcgggaaaaactttcccgttccgccacgcgcacaaacaatttcattgcatatattttatccatcatcaggctctattattgtttttattgaaacagtgacgctgaagcggctggttttattgattttctagcatctaataagccctttcgcaatcattgctcgcgtgacgaatacgtctgatcgcgttgcgcggcggatttatcgccttccggctaggcattttagcgccaaaaagccgataaacgggacgagagcggtaaaacacgctgatagccgcgggtgtagtgggagagagaaatgcatgtacatatacggtattgtcattgacccatcgtcgcggttttcaggcggattggctattttttaacaaaatgtgctactttattttttgtaacacataaggcgaaaagcagatatttcctttgtgacgcgccaggcgtactcttcattaaattaatattcaaattagccctgtctgtttgtactaataagatattccttactttaaaacgctaatgttagcgaattctgtaatcccgatgttgaagctgtaaatattcataacctttctcttcctcaaccaatgactatcggtaaaatggcctataccaaatggcgacttcttattttaccctacgggtaatacccttcctcatcttgagactattatcttacccaggtggagaaaagtaatgcaggtaatcatgtttgacaggcagtcaatatttattcatggaatgaaaatcagtttgcagcagcacattccaggaataagtatccagagtgtcggtcaggcagaagaactctggcaaaaaatagaaagcgcgccggatgcgctggtcatgctggatagcggcctggatgctgaattttgccgcgaggtgttacaaagaaccgcgcagcaatttccggaggtgaagattattatcacggcgatggatggcagtcaaaagtggctgcatgaagtcatgcaatttaacgttcaggtcgtggtgccacgcgattctgatgccgaaacctttgtccttgcgctcaatactgtcgctcgcgggatgatgtttttaccgggggattggttaaattcaacggagctggagtcccatgatataaaagcgttaagcgcccgccagcgggaaattttacagatgcttgccgcaggagaatcaaataaacaaattgggcgggcgttaaatattagtaccgggacggttaaagcgcatctggagtcgctttaccggcggctggatgtaaaaaatcgtacccaggccgccatgatgttaaatgaatcgaattaacgacgttaaattcgcagtccgcttatttctggctgtgaaatatcatccgtattgattaatgataaaaaacgctgatgtccgatgctgaacatcagcgcaataagcgtttcgcgttgaaaccgatcgttaagttccggcaagcaattctgtagcagcatatcgcagctattgaggtcatccagcaagaatgcctccgcctggtcgggcgtaatgaacgtcagcgtctcatccggcgtcaacatatgcccgtaaccaatcacccagttaccctgccgatcgcgatacttttccagcgacagaccctgccactgtttaataaacgcgatgcaggcggagctaaagcgagatgaaatgtgcggcatggcatctttctcataaaaagcgcgattataaagtgtgctgcacgcgtggctagcggtcagacggccaaacgcaggcagggaaaaggtctatgccgttcagcgtcacgccgcgttgacagaatgaaaaactgatgtttttggttagtaaccgatcttcttataaatttgcaatcattaagattaagtcactgaaatgtggctaaatctgttatatctatgaaaaaacataattaaaagaaaacgaagatctcgtcgcgggatcgtctttttagggaagataatgacgaatagcgcttcgcaggcgacacgcgcgccttttgaacatagcctggggattatccgccaggcatcaatagaaatcctgctgctgctgggtattcataccacagagggaaaagagccccggtggttcatggaacaacttgagcaggcgcgtcttaacctgggcggttggggcgcggtggcgaaaaaattgcggataaatgacgcgcagttgagccagtttatgctgcaactgcgtcatcttcagcagcatgttccccagtatgacagcgggcaagaggtgagcgaaaatcaactccttgccgcgttgcgttttgtcacctcgctggaacatctacgtcagcagcagccgctactgacgtatcaaactgagctggaagaccccgaccaggaggcgcatcttgaggcgcagcgtcagcttcgggcgatagaactgacgttaaaagcgcttattgcgcgcgcatggccggatcgggcgtccctgaatcactacctcaagcaacattttggcccggaccgtttgcgccagtggttaaaacagggagaagatcaacatgcgctggagggcatgttgtttagcgaactggcgcttatggtggtcgataaaaaattgtttgctcgtcattacgtcagaatttttaatgacgcctcagcgttaacgctgttcgccgagtcgcgcaccactctgcgtatgtttctggatgattgccgcctcgcgcgaaacgaggttatcgccaggcagccgctcacctcagcgcagcttatgctgctaaacgttcagtatcagcaaatcgttcggcccatccagcgcgcctatgccgaaaaacgtacccgcgtgaatcccgcttcgtttctgctggcggatgaacgtgaattgcgccagttctgggaaaccgcgcggcttaaagatcggcaggccgggggagataagcatgagattagcgagagcatagaaccaccgcgtaagcggcctccgcgtacgcctgaagagcgtgagcaacttatttccggcgctttgtggggcggggttggcgtcatgacgctggcgatactggcgggcgcgttctggctatttagttcgtcatcgccaagctccgataacgggcaagctcccgcaatggcgcaggatgaaccgccgcgcgaggcgccttccgcgcgggaaacgctcaatcatatggggattacctgggatgcgtttaccatgcgggcggcgatagagcgcaatgatacgcgggtgacggcgctgttcctccagggcggaatgaactggcagctcgcgtggacggagcaggcgtttgcggcaggacataccgaggtgctgcaactgttgttgcgttatcccgcgctgatggatgaggtcaaaccctgccgacgatttatcacaacgttaagtcatgacatgtcgagcggcgcgccgctgaccgcgatgcataaaacctatttgcaaacgttttgcaccgttccggctgttgtgacgcgccagcagtacgatacggagcaggcccagctgcgcgctcaggcccggcccagcgcagacaataaaaaatggctgaaaattcagtcagccatttatgatgcgattcactgagcccggagcaggttaaggctctccgtaaaggccaatcaggcggcgcaccacgccattggtccagccgaacccatcctgtagcggatactcgcccccgccgccttcgcggggcgtaccgccggaaatatggtatttctcgatcagtttatggtgctcctgataaaaatggttcaccgtttttaaccagttatgggcgatttcatcgcccagcatatcgtcgccataccgtttgaagccctgaatcgccatccattgcagcggcgcccagccgttcggtttatcccactgttcgccggtttcgtattcggtcgccataatcccgccgggcgttaacagacggctgcgtactacatttgccagacggtcggcctgctcatggttcgccataccgacatacagcggcacgatactggcggcggaaaagagcgccatttcttcgcgtcgccagtcatagtcccgataacagccgttttcatcatcccacaaataatggttcacggcggcgcgtcgatcgctggctttctggcgaaatagcgcctcggtgtcacgttcgcctttcagcgctgaaatattggcgatagcgctctccagtttatacagaaaagcgttcaaatcgatagggataaactgagttgtacgtatgctggcaagccggcccgcatcgcgtagccagcgtgaagaatagtcccagccggacgccgccccggcgcgcaaatcccggtagacttcattgggcggacgaccggaatgttttgcggtttcgacatcttccagccaggactcgtcgcgcggcgtgtcgcgatcgtcccagtagcggttcagcagggaaccgtccggcatccgcacaacgtggcgataagcctggttgagcgccagcgattcggcgccgtccatccagaaggcgtattccattttgagatggtcgagataacgccgcgcgccgcgcacgccatcttcttcgaacagttcaaccatcagggcgaaaaccggcggctgcgagcggctcagataataggtgcggttgccgttgggaatatgaccatagttttcaatcatccaggcgaaattatccgccatacatttaagtaagtcttcgcgcccgctttccgccagacccagcatggtaaaataagagtcccaataataggtttcgctaaaacggcctcccggcacgatataggattgcggcagcgccagcagcgaagaccacggaatatgatcctgcggttcgcgcgtcagtatcggccaaagctggtcaatatgttctttgagcgagttttcggggttagagacatactcgctggataaggtttccggtagccagaaatggttctcgacgaagcggcgtaagtcaaaatcacggtggcgtctgaccttacggtagcggatcaggatatcaagcgggtccatcttcggcgcgcagtccgggaacgttttactgtctggaaacagttttgttgactgtacatgctcgaacagttcgagataccgatcggcaggggtcagggcgtcagaggcgggaagcccctcgatcatctccggctccggttccgcctcgatcatttcatccagctttaactcgcacgggtctgtttcataaaacagatcgacatcaatagtcagatcttcagaaggcgtggggtttaatttctggttgagcataatgacaaggacctccggcttgcgtcgtaaaagatacgggtgttgcccggctgtctattaagcgtagacattcgcttcgatacctgagtggcaaagtgtgcggtagatcacattttgcaatttatctctcaaaaaaacacttcataacttactgaatagtattgcgaaaatcctattttcatgacgcctccctcagacctaaaatcagaacattcgtttcatagtggtatcactacgtcaccacatggcgtggattcacaaacaaaggtaacgtaaatagttataatacaagctatggcaccatgataatacaaatggatacaaatgatcgagcaacccgacagtaaaagcgccaaaccgctttataagcagcttgaagacgccttaaaagaggctattgcgcgtggagagtataaaccaggccagcagatcccgacggaaaatgaactgagcgtgcgctggcaggtgagcagggtcacggtccgtaaggcgctggatgcgctgacgcgtgaaaatttgctgacccgtgtctccggcaaaggcacctttgtttctggtgagaaatttcagcgtagcatgaccggcatcatgagtttcagcgagttatgccagtcccagggacgtcgcccggggtcacgcaccatcaaatccgtttttgaatcggtagacgatgagacaaaagcgttactgaatatgaacgatggcgaaaaagcggtcgtcattgaacgtatccgctatgccgacgatgtggcggtatcgctggaaaccgtacatcttcccccacgttttgcgtttttgctggacgaagatcttaataatcactctttgtatgaatgcttacgcgagaaataccatttatggtttacccactcccgtaagatgatcgaactggtttatgccagctttgaagtcgcccattatcttggcgttaacgagggttatccgctgatcctgataaaaagtgaaatgattgataacaaaggagaactctcctgcgtttcgcaacagttgattgtcggcgataaaatacggtttaccgtatgatgtcagcattacgctaacgaagagcaggctgaatcgggatccagatcgcggatcccgattttttttggtttccatcttgatcaaatgtctttaaatatcatataaaaataataatacattatgagtcatttatggcgaatcctcgcctgtatcattgatggaaccagaggaaagcatgatgggtatgaaagagacagttagcaatattgtgaccagccaggcagagaaaggaggcgttaaacacgtctattacgtggcgtgcggcggttcttatgcggcgttctatccggcgaaagcatttttagaaaaagaagcgaaagcgttgactgtcggtctgtataacagcggagaatttattaacaacccgccggtagcgctgggagaaaatgccgttgtggttgtcgcctcccacaaaggtaatacgccagagacaattaaagcggctgaaatcgcccgtcagcacggcgcgccggtcattggtttaacctggataatggattcaccgttggtggcgcattgcgactatgtggaaacgtacacgtttggcgacggtaaagatattgccggagagaaaacgatgaaaggcctgctgagtgcggtcgaactgctccagcagacggaagggtatgcgcactacgacgattttcaggatggcgtcagcaaaatcaaccgtatcgtctggcgtgcttgcgagcaggtagcggagcgtgcgcaggcgttcgcgcaggaatataaagacgataaagtcatttacgccgtcgccagcggcgcgggctatggcgcagcctacctacagagcatctgtatctttatggaaatgcaatggatacattccgcctgtattcatagcggtgagtttttccacgggccctttgaaattaccgatgcgaatacgcctttcttcttccagttttccgagggcaatacgcgggcggtggatgaacgcgcgttaaacttcctgaaaaaatatggccagcgatattatcctgaaactttcacagaaggtgaatgcgttattggcgcgggatgatgttgacggtgtggtcattactcatggcactgacacgctcgatgaaaccgcctactttcttaatttgaccgtgaaaagcgacaaaccggtggtgtttaccgctgcaatgcggcccgcgtcggcaatcagcgccgatggcgcaaggacagccagggctggtgtctgactcgctcaacccggcgaaggcgcgggtgttactgatgatggcattaactcagacgcgtaatccggaactgatccagagttatttcagtacgtattaatcatgaaggcctgtgcgcccaccctcgaagatgggcgcacaagatattaacgcatggtcacaaactcttccgatgcggtcgggtgaatagcgacggtattatcgaagtctttcttggtagcgcccatcttcagcgccactgcgaagccctgcaacatttcatccatgccgaagccgataccgtggatacccacaattttttcttccggcccgacgcagaccagcttcatacggcacggctggcggtgcgtcgtcaccgcggtatacatagcggtaaacgatgatttatagactttcacctgctcgtcgccgtactgctcgcgcgcctgcggctcgcttaacccgacagtgccgataggcggatggctaaagaccacggtcgggatgttgctgtagtccagatgctcgtccggcttgttgttaaacaggcgctcggagagacggcgaccggcggcgacggcgactggcgttagttctatcgcgccagtattgtcgccaacggcgtaaatgccttctacgttcgtgttctgccatttatcaacgatgatgtaacctttttcattggttttcacgcccgctgccgccagattaatattgtcggtcgacggttcgcgaccaatggcccagatcaggcaatcaacggtttcactgcggccatcttccagttccagagtcagactgccgtcggcgtttttcaccaccgctttcggcacggcgtgagtatgcagttgcgggccttcggcgttcatcacctcaaccagcgtttcgctaatcatcgggtcaaaactgcgcagcggcgcatgtttacggacaaacagatgcgttttcgcccccagcgcgttgataacgccagccagttcaacggcgatataacctgcgcctaccaccgcgacgcgctccggcaaggcagatagcgcaaagaaaccgtcggaatcaatgccgtattccacgcctggaatgctcggatggctcggacggccgccggtagcgatcaaaatatggtcagcggtgatggtttcgccgttcacttcaatggttttggcatcgacaaagcgggcaaagcctttaatcacatctacgttatttttgcccagcacgttgtcgtatgaagtatggatgcggtcaatatacgcggtacggctggcaatcagcttgctccagtcgaactgattaatcgtggtgtcaaaaccgtagtccgggccatacagatgaatcgcttcacgaatctgcgcggcatgccacatcactttcttcggcacgcagcccacgttaacacaggtgccgcccagctctttggcttcgatgagcgcgcatttctggccgtacatagcggcgcggttaatcgaggcgataccgccgctgccgccgccgatagcgatgtaatcatagtgtttggtcatgaccgctcctttatgttcgttgtcggacggatagattctgcgctacccgccaaaatattcgcgattgtatacctgaaggtgaaaggttccaccgatggctgtgattactccggcacgatccagcttaccgaagtgtgtccgtgaccgtttggcgccaacctgctgtgcagccacggtagcacgttgttcatctgctgctccagtttccacggcgggttaaccacgatcataccggacgccgtcatcccgcgctgatcgctgtccgggcggatcgccagctcaatttgcaggattttacggatgccggtggcctccagctcatgaatcatgcgcttaatttgctggcggagtaccaccggataccatagcgcgtatgtaccggtggcgaaacgtttataaccctcgctgatgccgctgactaccgcctggtaatcggttttcatttcataaggcgggtcaatgagaatcagaccgcggcgggaaaccggcggcaatttggctttcagttgctgatagccgtcagcgcgttccacgcgggcgcggttgtctttttgaaactccgcgcgcaacagtgggaagtcgctgggatgcaattccgtgagttgcagactgtcctgctcacgcagcaactggcgggcgattaacggggagcccggatagtagcgtaactgcccgctgcggttgaaatgttttacgacgctaatatacggttccagttcggcgggcagatcgtcctgctgccagatacgggcgatgccttccagatactctccggtacgttcagcatgttcgctgcccaactgataacgccccgcgcccgcgtgcgtgtccagatagagaaacggtttttctttctcttttagcgactcgatgatcaggctctgaacggtatgtttaaggacgtcggcgtggttgccagcgtgaaagctgtgacgataactgagcatggatgcagatattccgggaagtaaacaagttagccgatagtttaccgcagatccgtagagattaccgctcttgcgcttttatcgccgttggccaggaggaaaaacaagtaggctgtggcgtcagagcgtaaataacgtcaacgaagtgatgcaggcgtctggattggcctgtttcacggtcttaaggaaggtggcaaaatttcgattgaatagggtgtagttatgaaggaagcgcgtctgttttctttgcccttccgctgttatccagtcgactgaccagactgaacgaccactgactctcgttgttcccggtttcgcctcaataatgctggtgagtggtatcgcggtggtgataccgtccgcgacctcatagaggtactgcatgtcaaagtagtaatccgcgttatagccgcgagaactgccaaattttcgcagcatcagcgaagaagatgaaattaatttacggccatcttgcagatgcttactccgacggaaaatttttcgcccagggaaaataaagaaaacaataaatatcagtacaataacctgtaataacgtggtcatatacaatccttgtattccagaaacgaaaaagttgagaatattatacatgggcagtttgcgcaaaaatgacagcgattgatgtcacggccctgttttcagaaaaacacccatgaaaagcctatctgaatttaacgctaatcatgccgcgacgcgtccaccgacttacccctgtcgggtcttattctgaaatcgtttttattatgatgatagtgctggttttaccttgtttatttgattaaaacgatagcgctaataatagaaaagaaaggattcattgatgttccattatggaaaatgtgtcgttcgcacgttgtttttattactggtttgctgttcgctgtcgggctgtctttcatttgggctgatacttgccaccgataaagatggcaatcgtcatcagtctacctggaaatcggataccgttaccgcgctttccttaggtaaagatagcaacgggaaaacgggctgggtgtttgttggcgaacattttgactacctgttgacccagggcggcgataatgtggtggcgctgttaaaagatgcgactattcgccgggataaaatgcgagtaaaggatggtgttaaattcctgattgatacagataagaaggagtttacgggtgaagtcaatgtgacttacgcctgggtggacgagaaagataaactggcggcggtaggctacgggtttatttgtgcagacggcgcggtaaattgcacgctatccgtcatggacctgaaagggactatccatcagaaaaataaagagcagagcgttacgcagcagctatcgttctatcatcctttcaccgttgagttctatcagtatcagcgcagtatgtccggggcaaaatttggcagagtgttgctgccggtaactttggcgctggatattgtcactatgccgctacagctactgatcttcagtcgttaaaattggattcagcagcaatgcctacgttcggatgctggcgttgctgcacgggtgaaatgagcgcccaccatcattgaaattcccccaactatcccccattctagatccatagcgaaagcgcgatagagcgcttcatttcttttttagaccaggactgcgcatatgaccaatccattactaacgtctttttcactgccgcctttttctgcaattaaaccggagcatgtggtgcctgcggtcaccaaagcgttggccgattgccgggcggcggtagaaggcgttgtggcgcatggcgcgccgtatagctgggaaaacctctgccagccgttggcggaagccgacgatgttctggggcgtattttctcgccaattagccacttaaactcggtgaaaaatagcccggagctgcgtgaagcctacgaacagacgttaccgctgctgtcggaatacagcacctgggttgggcaacatgaaggactgtacaacgcgtaccgcgacctgcgcgacggcgatcattacgccactctgaataccgcgcagaagaaagcggttgataacgcgctgcgtgattttgaactgtccggcatcggcctgccgaaagagaaacagcagcgttacggtgaaattgccacccgcctgtctgagctgggcaaccagtacagcaataatgtgctcgatgccaccatgggctggacgaagctcatcaccgacgaagccgagctggcgggaatgccggaaagcgcgctcgccgccgctaaagccctggcggaagccaaagagcaggaaggttacctgctgactctggatatcccgagctatctgccagtgatgacctactgcgacaaccaggcgttgcgtgaagagatgtatcgcgcctattccactcgtgcctccgatcaggggccgaacgccggtaagtgggataacagcccggtgatggaagaaattcttgcgctgcgccatgaactggcgcaactgctgggcttcgaaaattatgcccatgagtcactggccaccaagatggcggaaaatccgcagcaggtgctcgatttcttaaccgatctggcgaaacgcgcccgtccgcagggggaaaaagagctggcccagctgcgcgccttcgccaaagccgaatttggcgttgaggaactgcaaccatgggatatcgcgtactacagtgaaaagcaaaaacagcacctgtacagcatcagcgatgagcagctacgcccgtacttcccggaaaacaaagccgtgaacggcctgtttgaagtggtgaaacgtatttacggcatcaccgccaaagagcgtactgatgttgatgtctggcacccggaggtgcgtttcttcgaactgtatgacgaaaataacgagctgcgcggcagcttctaccttgacctgtacgcgcgcgaacacaaacgcggcggggcgtggatggacgactgtgtcggccagatgcgtaaagcggatggcacattgcaaaagccggtcgcttatctgacctgtaatttcaaccgtccggtgaacggtaaacccgctctgtttacccatgacgaagtgatcaccctgttccacgagtttggtcatggcctgcatcatatgctgacccgcattgagaccgccggggtctccggtatcagcggcgtgccgtgggatgcggtcgaactgccaagtcagtttatggaaaactggtgctgggagccagaagcgctggcgtttatctccggccactatgagaccggcgaaccgctgccgaaggaactgctggataaaatgctggcggcgaaaaactatcaggcggcgctgtttattctgcgtcagctggagttcggtctgtttgatttccgtctgcatgcggaatttaacccgcagcaaggagcgaaaattcttgatacgctctttgaaattaaaaaacaggtcgccgtggtgccgtcaccgacatggggccgtttcccacatgcgttcagccatatctttgctggcggctatgcggcaggctactacagctatctgtgggccgacgtactggcggcggacgcttattctcgctttgaggaggaaggcattttcaaccgtgagaccggtcagtcgttccttgataacatcctgactcgcggtggttctgaagagccgatggaactctttaaacgcttccgtggccgtgaaccacagctggacgcgatgctggagcattacgggattaaaggctgattttacgtgcaaatctgcttaatggatgaaacgggcgccacagacggcgccttatctgttctggctgcccgctggggactggagcatgacgaagacaacccgatggcgctggtattgacgccgcaacatctggagctgcgcaagcgcgacgaaccgaagctcggcggcatttttgtcgattttgtcggcggcgcgatggcgcaccggcgcaagttcggcggcgggcgcggcgaagcggtggcgaaagccgtcggtatcaaaggcgattacctgccggatgtggttgatgccacggccggactggggcgcgatgcgtttgtgctggcgtccgtcggttgccgcgtgcggatgctggagcgtaatccggtggtcgccgcgttgctcgacgacggcctgacgcgcggctacgccgatgcggacattggcggctggcttcaggagcgtttgcagttgattcatgcttccagcctgacggcgttaaccgatatcacgccgcgcccgcaggtggtctacctcgatccgatgtttcctcaccggcagaaaagcgcgctggtgaagaaagagatgcgggtgtttcagtcgctggtggggccggatctcgacgccgacggactgctggaaccggcgcgtcagttggcgaccaaacgcgtggtggtcaaacgtcccgattatgcgccgccgctggcggatgtcgcgacgcccaacgccatcgtcaccaaagagcatcggtttgatatttatgccggaacccctctgacggagtaacggattgcccgatggcgctacgcttatcgggcctacgattctcaattatttgtaggccggataaggcgtaagccgcatccggcactgagtattactgttcggtaccttgcgtattaatcattcggtttaaccacggcaccataatggccatcaccacggtgaccgccagcgttaccagaccaattttgctaaagacgccggtataaatgggcagcgtctgtaacggatcggtgatgttttccggtacggcagtgaaggtcgccacataaccgccgagcaggaaggcggcggcctgggtcaggaaccacattcccagaataaagcccatcagatgctgcggcaccagagcggcgaccattgccagtcccagcgcgctaatcagcaactcgcccagaccctggaacagatacactagcacgataaaccacggcgacgtcaatccttgcgcatcggcaaaccacatcccggcggcggcggtcagaaaacccagcgcgcagaggaacatgccgagcgtaaacttcatcggcatagtcagatctttgcctttgctacccagtcgggtgtaaatcgctgccagtaccggactggcgacgaccacccagaatgggttcagcgcctgaaaactcaccgggttaatggcgaatccaagaatttcatgatgcacgttattaatcgcaaagaagttcagtgaggtaggcatctgcgcatacagaatgtaaaacagcacggcttcaatcatcagaataaacgccacgaacattttattgcggccggttttatccagacgaaacgcttcgcgaaagaagaaaatagtgacgacgatagaaaggacgatgagcaccagattggcaatcttaacgttgtgcatcagccaggcgcagaggaaaatcatgacgacggtgccgagtagtaccagcagcaaattgcgaaaacgtagcggtttatgatccggttcagaaccgatatttttcaccatgccacggcaggcgaagtacaccagaagcgcaacaattaaaccagcgccgcacagattataggtcaccgcatagccaaatttatcggcaatcaccggcgccagcgatagcgataacaaagaaccgatgttaatcgacatataaaacagggtgaaagcgccatccagccggggatctttaggctgatagcatttagagagcaggctggcgggattggctttaaataacccgttgcccacggcaatcgtacccagtgcgataaaaatcagatcgggatttaatagcgacataccagtcataaaatagccaatcgccagcacaatcgcgcccaggaccagggtgcgtttagtccctaacagatggtcgccaacatagccgccgatggagatcaggccataaaccagcgccgcaaaagcgccaaaagtaataaaggcctgttcctgagaaaaacccaattgtttaacgaaaaagaccgccaggatgccctggacgccgtaatagctaaatcgttcccataattctacaaaaaagatcatgaagaatggacgaggttgctgcagcaagcccgtaggtgcagttgtattcatattccttcgccttttaatgccatcccgaaacgtatgaacgcgtatatcaaaacgcgccgaaaagtcttaccctgatatagactgcggttattagcctgatcaataggttattatacaaatgatacgcaaactaattagtggatcacactaattatgtttggtgtgatggaatgatgtactgagtactgcgaagaaggggggataaacaaaacgcccacataagcgggcgttgttgttgatagccggagtttgcctgatggttcaggccaacctgattgactatagaccagatgcggtcttagccgccagccggcacggtaagtattactcttcttcgtcgcgcagcggaacaatcagcatgtcaacgtgaacggtgttgatcagctggcgcgcagaagacatcagtttgctccagaagtcctggtgatgaccgcaaacgaccagatccatatcgtatttcttgatggcgtcaaccagcacctggcccaaatcgccgctaccgctcagggtttcagtgatagggtagccagcgttggtagacagctcggtcagcgcgtggtgggtttctttggagatacgtttctgcatatcgcccagattgacgtcaatcagaccggtgtacaggtctgaatagttcacatcaacgtggatgagggagattttcgcgttgtaggggcgcgccatagagaccgctttttcaaccagaactttactttccggggagagatcaactgcgataagaatgtgtttataagccatagtgttactccttccataagttgtcgatgaccattgagctactggcgtttcttatgccgccgcgtcacccgcgtcctgcgaactctatgcgcggggctagctcagccgtttaccataactatccttacattatagcgaccaggataatccgtcaatctgccttgcttgccagttagttaaacaaaattttcagggaattgcattgatagtgattaaccttctggtaaaaaaattaactgatctcctacaatgtgtataagagccgttcgaatgcggagcgctaatatggacggctttcgtagtactctttcactgattgtctggcagggtatcggggagcggtagtcccggagaggaactccgtgggcgggtcgccggggaggagatatgataagcaccgtctcactattctgggctttatgtgtcgtttgcattgttaatatggcgcgctatttctcatcgctacgcgcactgttagtggtacttcgtggttgcgatcctttgctctatcaatatgtcgatggcggcggcttctttaccacgcatggtcagcccaacaaacaggtgcgcctggtatggtatatctacgctcagcgctatcgcgatcatcatgatgaagaatttattcgccgttgtgaacgcgtgcgccgccagtttctgctgaccagcgcgttatgcggtttggtggtggtgagcttgattgcgctcatgatttggcactgaataaaaaaagcgggccagtttcctgacccgctcgtattagataagcctccggatgacgccgcttgtagcggcctgtcaggcctgtgtcgtttcatcctgacaggccggattagcgacagcgctatccggcccatttggcttaaataatcttcagggaaagccagtacagcacgccggaaagaataatcgccgccggtaacgtaaatacccaggccatcagaatgctggtcacggttttacgctgtaacccgccgccatcaacgaccatggttcccgccactgaagaggagagtacgtgagtggtagaaactggcataccggtgtagctggcaagaccgatagagactgccgccgtcatctgcgccgacattccctgcgcatacgtcatgccttttttaccaattttctcgccgatagtggtcgccacgcgacgccagccgatcatcgtaccaatacccagcgccaacgccactgccataatgatccacaccggcgcatactcaatggtgcttaacatatcggtcttcagctttttcagcaggcgctggtcatcgctgcttacgccaggcaatttcacgactttgtcggtcgtgtcggaaatgcacagcataatgcgacgcaactgactacgctgttcaacgcttaacttgtcgtagctttccacgtttgccagcatccctttcgcacggttaagcgcgttaatggtgttagccggatggcagtggaattcagtcggttcagtcgcgcccggttccggagagggaatcagttggtcaacgccggtgacggctttcagcaggtcaggacgctgctcaaagtacgtttcgacattgttgatagcatcgcgcgtacgggtgatttcgtagctggaggcattcatattgaccacgaaacccgcaggcgcgacgccaatcagcaccagcatgaccaggccaatgcctttctgaccatcgttcgcgccatgcgaaaacgccacgccgatagctgagaggatcagcgcgatacgcgtccagaatggcggctttttcttgccgtctttcttttcacgttcggctggcgtcaggtggatacgggcgcgtttcttagtaccgctccagtagcggcgcagcaagaaaatcagaccgccggcgaataccagaccgacaataggggagataatgagtgaaccgaaaatattgataactttcgggatgttaagcgcatccaccactgacgtgccggtcatcatcgcattggttaaaccgatgccgataatggcgccaatcagcgtgtgggaactggacgccggcaacccgaaataccaggtaccgaggttccagataatcgccgccagcaacatggaaaagaccatagcgaggccgtgcgcggaacccatgttgagcaggagatccgtcggtagcatatgcacaatggcatacgccacgctgagaccccccagcaaaacgccaaaaaagttaaacactgccgccatgacaaccgccagctgcgaacgcatcgcacgggtgtaaatcacggttgcgactgcattggctgtatcatggaaaccgttaatcgcttcgtagaacagcacaaaagccagagcaagcaataataaaagcccggtatgtaaatccaggccagcaaacaaatgtagcataggacgttacgccattttgaggacatgaacgcggcgcattatcagtgactttggcggcgcgggcaaagtgaaatatagactttttttgatgtacttcgtgctttgtttgatatcactaaagaattatcttatatatttcagataaataccattttcaggcgcttttcgcgctggtgcgaccactgaggaaactttacaattctcgcccgaatttgagagaggaaggcgacgtggaaaggtttgatgctgttattataggcgctggcgcagcgggcatgttttgcgccgcacaggcaggacaagcgggtagccgcgtgctgctcatcgataatggcaagaagccaggacgtaaaatcctcatgtccggcggtgggcgctgcaactttactaatctttatgttgagcctgctgcgtatttgagccagaacccccatttttgcaaatcagcattagcccgctatacccagtgggactttatcgatctggtcggcaggtatgggatagcctggcatgagaaaacgctgggacagcttttttgcgatgattccgcccaacgcattgtcgatatgctggttgccgagtgcgacaaaggtggcgtaacgatgcgcctgcgtagcgaggtattgagcgtcgagcgtgatgagtcgggtttcgtactggcgttgaacggcgagacggtgactacgcaaaagctggtgattgccagcggcggcctgtcgatgccggggcttggcgcatcgccgtttggctataaaatcgccgaacagtttggtctcaaggtgttgccgacgcgcgccgggctggtgccctttacgctacataagccgctgttagaacagctccagacgctgtctggcgtctctgtgccctgcgtgattaccgcccgcaatggcacggtatttcgggaaaacctactttttacccatcgtgggctgtccggccccgccgttttacagatttccagctactggcaaccgggcgagttagtgagcattaacttattgccggatctctcgctggaagacgttctcaatgaacagcgtaacgcgcacccgaaccagagtctgaagaacacgctggcgatgcatctgccgaaacggctggtggagtgtttacaacagttggggctcatcccggatgtatcgctcaggcagttgaacgttcgtgaccagcagacgttggttgacacgctgacggcctggcaagtacagcctaacggtaccgaaggctatcggacagcggaagtgacgctgggcggcgtggatacaaacgaactatcatcgcggactatggaggcgcgccgcgtgccgggtctctattttatcggcgaagtgatggacgtcaccggctggttgggcggctataacttccagtgggcctggtcgagcgcctgggcctgcgcgcaggatttgattgcgttaaaaattaactaattgatattatgtgtttttcggtctcatttgactgatcgccgtatatcttggcctatagcatcttttagtcagaagtattctggataaggggcactcattttgcatggcatgaccaccgatttcgttttaacaatggggaatgcggacggtagttttcgctataaggtcgtggcagtaaaaccagataaattggtttcagctcgggagcctgaataactttagattgaacatctgttctggatgttactttgggttgatttcccgatttgcgttgactcaaaacagaatcaagtttagagataaaaatgtgttagacgatatctataatcagaatgaaacatgtttaaccattttcattatgaatgcattaatctcagctgggttttgaagcagaccgcattcaggtcggatactggccaacaacaccagatacagaataaggcccctgacagggccttctggtagtatgtagtcgatatttacactgtttacaacggggagtcatactttcttattaatcctgtaaagcaaaccactgcacagtgcgccagcaaaaagaacaactgcaatagtggcaaacatcagcgtatatgcaaattctttatacgtatcaagaaggtatccgaagataagatggacataagcttccgggctgaatccgatgcagattaatatccccattgcggtcccggtaaacactttcggtatgcgaatttcatttacctgcgcatacattataccgcgcatgccaaacgtaagcgctcccagtaataaaaccagagtaataagcaggatcagaaatcgtgagtcatgaggaataaatataaaagatgcagttatcaatgcaccgagaataaagaagctggccataactttcagggaagaaccaatcttatctgcaagtaggccagcaaaaggcgaaataataaaagcgagaaaatatgccctaatcatcccgataacggcagtttggtcgggagtcattccataggcatcggagaggtatggtaccagataagctccgccctggtaaacaaaaataacacagctgataatgaatgctgccagccaaagttttacacttttgagtagtgaaataagatccgacatttttttaggtgccgcattttcaatagcactaacacctttcggaaataaataataagaggtgaatcccagaataatataaatggctgcgtcaaatcgtaaaataaaaccaatgctgacagcactggagccatgcagaccaacaatagccacggcacataacgtcagaacagtgccggcaattccacgaccggactccagaaatccaaaataccgcccctgctcattgtctgatgcaaggagtctggcaatttttgtcatggaaaccaggaacagtccattaccgactaaggacataaatccgacgataataaacatggcctgataggaaggccggaaggactgccagatggcaagggccgccattgtgagataggcaatggtaagaatgcttttaggatttttgaaacggtcaacgatgatgcctgaaacagcacctgatataatgcctacaaacccgagccagctcattaacatgcccgattgtgtatttgtcagtgaaaagtattcattccacggatagtagaatacttcacgcaaatacatagccttgaatattgttcccccaccgactgccagaagaataaaaaaatcaggttatgccttttaatcgatttgtcttctgcatgttccatatgtccgcctgtataactagacgttattgtagattgatccgttagtgtcttgtgttattttaatttttgtatgtatttataaacagtgggttcagatatgttaagttttttggctactttcgttactgcccctttaagcagaaatacgccttcatcatttagtaatgaaataatatggcttttattttcagcattcagtgactctggattaatattttcaatattgattacattattaattttgagatcaaccatttcaggaatggtcagtccaatatgttcatcaagctgagtgccgttattattgtcagtctgcccgacaaaaatgcttaaaaaatgactaagtttatcattcagggcaattaaatcttcgacgacggtattcagacatagtgcaccaacaatttctccctgcttattccggataaaaaaagtggcacacttaagccgtctgccatcgcgtgtcttgctgagataattacactggtaatgtacctcactgtcattgttcttcatggcacggactaccagatcggtgatgggatctccgacagagcgaccgctgatatgtccatttctgattttatgtatagaagactcaagatcagaaagattgtgcagaacaacttccgtgttttcgccaaaataatcggccaggaaatcgatcaaaaattcatagggttcaagacaagtgtttttcatggttaatctggttgccacctcagtggcaaccacctttgttattgacgaaatgccacagcttcaatctcaactctggcacccataggaagtgtttttacagcaaaacagctgcgtgccggcggatttatcttaaaaaagctggcatagacatcgttgaacgcagcaaaatcagccatatcactcaagaaacaggtcgttttcagtaccgtatcagtatcaccgcctgccatcttaactacagccagaagattaagcagtgactgacgggtctgttcctgaatatcatcagtttcaattttgccactgtcagcgttaatgggcaattgtccggaggtaaaaattaaattacccatcgcattgccctgactgtatgagccaattgctgccggtgctgtttctgtaaaaataatctctttcacttctgttccttaaaaatacttactgaatgccttttccagacgactcagtgcttcatcaatacgtgactccggaacaccacagttaattcgggcaaatccggtaccggcaacaccaaactgatctccccggttaaatccgagtcccgcatcctgcactaaaaattcctgaatgcgatcacctgaccagcccgtatcattaaagtcggcccatacaagataagtggcttccggcagattggcttttaccggatatggcatgttattgagcccgttaaccagtttaatctgcattttacggatatgattcaccacctcttcacgatagtcatggtaatatttatatccggcataggcggcttcatgcgcgaacgcagtgggctgaaaatgtaattctttcaggacaactgccatctgttttttaaatacaggatcggccgtgaagacataggaactaaaaataccgccaatgttaaacagcttccctccggataaaaaaacgataatgccatttaaattttccgcagctttcatgaccggcgtatagcatttttcgtcatagacaaaatctgcatgaatttcgtcagaaatcaggattgttcctgttttctgggcaattgcggcgactttcctgacttcctcttcagtccagcaacgacctaccggattatgagggttacagaaaatcagaatcttattctccgggcgtgaacaggtatcttccagcttttcaaaatcaatagtgtaatgattgttttcatcacgcagcagatcacactcagttacagcacggtggttttcacggatggttctggcaaaagaatgatagaccggtgtcataaccacaacggattcattacactgtgtcattcccctgataaaagcgcccatcgtcatcagtaaaggcggtgtttcaataatatcagccgtatccggccgccagtcataatatcgatcataccaggatgccagcacatccttaaaatcatcatgataggccggatatccgaattctctgcggttacagacttcaatcagtgcctgacgaacctccacgggagaaactaaatcggtatctgcaacagacataggtattactggaaatccattaatgacactgtcatattcccatttttctgatgctattctctgatagatttcattaaaatcgtatttcattttattttccttaatttattcagccgcagtccggaaagtatctgccggtttaccatccattttcttaaatgccgttttggcattgcggagaagtaaaagtgaagtgaatacagcgagagcaaacatggcacccatgaagataaacatgtaggtgtaaccctgtactttatatgcatcaagccagtacccgaataacgcatggataaacatttccggagagaatcccacagtggccatgatccccataacggtaccggtcagacgaacaggaaccttcatttcctcaatttgcgcatacatgatcccgcgcagagcaaagttaatggagcctacaatcatcagggtgccgatcaggacccataccatagccggatcctgtgggatcaccaggaacatggcgacaccaatcaccccggcaataaacagccaattcatcaccttaatcgctgagccgactttgtctgcgagcagacccacaaccggtgcaatcaggatagcgaggacataagcacggatcataccgataattccggcatgttcggcggtcattccgtagacatcagacagataaggaaccagatatgaggacccctgatagaaggagatggttgcaaagatggagaaagctgcaaaccagacttccttaaccttcatgacagccagaatatcgtgtacagatattttttccttggccttttcttctccggaagcagaattatggttatcacggggcatggcgaaccacatcagaacacccagcgctaggtagagaaagccgtatgcatgtagcacactgccaatcccttccacttcggttgcagacatggcgaaccatgctacggcaacggcagagatggctgacccagcgataccacgtccggactccaggaaaccaaacagcttcccctggtcactggcattaccaatcaggcgggttgcgcgcaccatcgatactaggaaaagaccatttgcgaggaaagatagtatgccgatgatgacatactgcgtagccagacccggtgctgttgactgccataatgtggttacgcccacagccagaaaggtaaaagaaataatcagtcgggtattgttcaccttatcgataatcaccccagcaattgaagatgaaacaatccccacaaaccccagccaactcatcagcaggcctgaatccgtgttattcactcccatgaattcattccaggggtaataaaatacttccctgaggtacatcgatttaaaaatggtccctcctccgattgccagaagaatgaccatcaaccatttttgaaaattggatgttttcataaaccttcgcctgtccataaataagaaacaagtgttcatgtgagaatataattttttatacacatgaatattatgaagcacttcacagagtgggcaaaaaagataaaaaattatctcttctaatttaatatcattaaaatcatgtagttatatgtataataaattatacatatgtgtggggcattaattatttacggttgtaattttataaaaattataaatttttatatttcaggacgtaactgtctgacaacatatatgctgaatagggcggagaataggggcaggaaagtggataaaatattatcgtgttttacctccggcaggagcgtttccttattagaagtacgaatatttgatgccgtgggctgtatccatgttttttagccgggcccggcgacttgagcaggggtaatcacgcatgctttcgttaccagccccttcggtaaatagattgacgggcacgattttttgtctgcaacatctgtgctacaaccgaatagacatattgaatccaggtgttagtattcaatagacagcagttatgagtatgcgtgtttcatttccggccaggaacgctgatgatgacaacattactacccggtttcacagcattttcgtcattcacttccttcgcggcgcgcgttgccttaacgctcgctcaatggccattgtttttcattccttcttatcccggatggaaacccccgctgagcgcacgcccggcggactttgtgacacgcatggttaggcaacagggattacggcgggtcgattatggacaaaatgaagcgtcatctggtgtggtggggagcggggattcttgtggcggtggccgcgatcgcctggtggatgctgcgccctgcgggaataccggaggggtttgccgccagcaatggcagaattgaagccaccgaagtggatattgccactaagattgccgggcgtattgataccatcctcgtttcggaagggcagttcgttcgtcagggcgaggtgctggcgaaaatggatacccgcgtattgcaggagcagcggctggaggcgattgcgcagattaaagaggccgagagcgcagttgccgccgcccgtgccttgctggagcaacgccagagtgaaatgcgcgccgcgcagtcggtcgtcaaacagcgggaagctgagctggactccgtctctaaacgtcacgtgcgttctcgttcgctgtcgcagcgtggcgcggtatctgtacaacagttagatgacgatcgcgcggcggcggaaagcgcgcgcgccgccctggagaccgccaaagcgcaggtatctgcggcaaaagcggcgattgaggcggcgcgtaccagtattatccaggcgcaaacgcgcgtggaagcggcgcaggcgaccgagcggcgtattgtcgccgacatcgacgacagcgaattaaaagcgccgcgcgatggacgtgtgcagtaccgcgttgcggagccgggcgaagtgttatcggctggcggccgggtgttgaacatggtcgatctcagcgatgtttatatgacatttttcctgccgaccgaacaggcggggttgttgaagatcggcggcgacgcgcgactggtgctggacgccgcgccggatctgcgtattccggcgaccatcagttttgtcgccagcgtggcgcagttcacacccaaaaccgtggaaacccacgatgaacggctgaagctgatgttccgcgtcaaagcgcgtattccgccagagctgctgcgacagcatctggaatatgtcaaaaccggtttgccgggaatggcctgggttcgtctggatgagcgcgtgccctggcctgacgatctgaacgtgaggttgtcgcaatgacgtcgctgacgctggtgcctgttcctcccgtggcgcagcttgagggggtgagccagcattacggaaaaacggtcgcgctgaacaatatcacgctggacattcccgcccgtagtatggtcgggctgattggtccggacggggtgggtaagtcgagcctgctgtcgctgatttctggcgcgcgggtgattgagcaagggaacgttatcgtcctgggcggcgatatgcgcgatgcgaaacatcgccgcgacgtctgtccgcgcatcgcctggatgccgcaggggctggggaaaaacctttatcacacgctatcggtttatgagaacgtcgattttttcgctcgtctctttggtcatgacaaagctgaacgcgaagcgcgtattaccgagctgctgaacagcaccggcctggcgccgtttcgtgatcgtcctgccgggaagctgtccggtgggatgaaacaaaagctggggctgtgctgtgcgctgattcatgacccggaattactgattcttgatgagcctaccaccggcgtggactcgctctcccgcgctcagttctgggacttaatcgacagtatccgccaacggcagaccaatatgagcgtgttggtcgcaacggcctatatggaagaggcggagcgttttgactggctggtggcgatgaatgcgggcgagatactggcaaccggcagcgcgcagcaactgcgggcaaaaacccatagcgcgacgctggagcaggcgtttatcgccctgttgccagaagcgcagcgccaggcgcataagccagtggtgatcccgccgtatcacgctgagcaggaagagattgccattgaggcgaaagatctgaccatgcgcttcggtaagttcgtcgcggttgaccatgttaatttccgcattccgcgcggcgagatttttggcttcctcggttcaaacggctgcggcaaatcgaccaccatgaaaatgctgaccggtctgcttcccgccagcgaaggccaagcctggctatttggccagccggtagacccgaacgacatcgatacccgtcgccgggtcgggtatatgtcgcaggctttttcgctctataacgaactcaccgtgcggcagaatctggaacttcatgcccgcctgtttcatattccgccagcggagatcccggcgcgcgttgcgcagatgatcgaacgctttatgctaacggaggtggaagatacgctccccgcttcgttgccgctcggtatccgccagcgtttatcgttggcggtagcggtgatccatcgcccggaaatgctgattcttgatgagccaacgtccggcgttgatccggtcgccagggatatgttctggcagcttatggtcgatctttcgcgtcaggataaagtgacgatttttatctcgacccattttatgaacgaagcggaacgttgcgaccgaatgtcattgatgcacgccggtaaagtgctcgccagcggtacgccgcaggaattggtgcaacagcggggcgcggccaatctggaagcggcgtttatttcctggctacaggaagctgcgggagcggcgcctgaaaccccaataccgccatcccagacgcccgccgcgtcagataaaccgtcgcggcagggattgagcttccggcgtttgttcagctacagtcgccgcgaagcgctggagctacgccgcgatccggtacgctcgacgctggcgctgctgggaacggtaattctgatgctgattatgggctatggcatcagtatggacgtggagaacctgcgttttgccgtactcgaccgcgatcaaaccgtcagcagccaggcatggtcgctcaatctggcgggatcgcgctattttatcgaacagccgccgctcgccagctatgacgagcttgaccggcggatgcgttcgggagagttggcggttgccattgagatcccgcctaattttggccgcgatattgctcgcggtacgccagcgcagattggcgtctgggtggatggcgccatgcccagccgcgccgagacggtgaaggggtacgttcaggcgatgcaccaaagctggctgcaggaggcggcaagtcgtcagccgaacccggttaaacaaaccgggctgctcaacattgaaacgcgctatcgctataacccggatgtgaaaagtctgcccgctatcgttccggcggtcattccgctgctgctcatgatgatcccgtcaatgcttagcgccctgagcgtggtgcgggagaaagagctggggccgatgattaatctgtacgtaacgccgacgacgcgcagtgaatttttgctgggtaaacaactgccgtatatcgcgctgggtatgctgaacttcttgctactgtgcgcgctgtcggtctttgtgttcggcgtgccgctgaaaggcagctttctcacgcttaccctcgcggcgctgctttacgtcatcatcgccaccggtctggggctgctgatctccacgtttatgaagagccaaatcgccgctatttttgggacgtcgattattaccctcattccggcaacacaattttccggcatgatcgatccggtggcttcgctggaaggaccgggaagatggatcggcgagatctacccgaccagccattttctgacgatcgcgcgcgggacgttttccaaagcgttggatctgtccgatctctggtcgttatttatgccgttactgattgccgtcccggtggtgatgggtctgagcattctgctgctgaaaaaacaggaggggtaatgcgcggattacgtaatatttataacctcggcgtcaaagaactgcgcagtctgctgggcgacaaagcgatgctggcgctgatcgtcttcgcctttacgatttcggtttactcctccgcgaccgtcctgcccggttcgttgcatcttgcccctatcgccatcgccgatatggatcagtcacagttgtcgaaccgtattgtgaatagtttttaccgcccgtggtttctgccgccggagatgattacggcaacggaaatggatgccggactggatgccggacgctatacctttgcggtcaatattccgccgaatttccagcgtgatgtgctggccggacgtcagcctgatatccaggttaacgtcgatgcgacgcgcatgagccaggcgtttaccggcaacagttatatccagaatattattagcggcgaggtcaacagctttgtggcgcgcgcggggagatagcgttcagccggtgtcgctggaaattcggatgcgctttaacccgaatctggacccggcgtggtttggcggcgtgatggcgattatcaacaacattaccatgctggcgatagtgctgaccggatcggcgctgatccgcgagcgagaacatggcacggtagagcatctgttagtgatgccggtcacgccctttgagatcatgatggcaaaagtgtggtcgatggggctggtcgtgctggtggtttccggtttgtctttgatgctgatggtgaaaggcgtacttggcgtaccgattgaaggatcgatcccattgtttatgttgggcgtggcgctgagcctgttcgccaccacttcaattgggatttttatgggcaccatcgcccgttcgatgccgcagctggggttattaatgattctggtgctgttgccgctacaaatgctctccggcggttccacgccgcgcgaaagtatgccgcaggcggtgcaggatattatgctgaccatgccaacgacgcattttgtcagccttgcccaggctattctttatcgcggcgcaggtttaagtattgtctggccgcagttcctgaccctgctggcgataggcggcgtgttcttcctgatagcgctgttacgcttcagaaaaacgattggcacgatggcgcaaacattattgccggatggcggctgcgcctcatccggcctacaaacgacgacgtgcgaacgtaggccgggcaagcgaagcgcccccggcaaggcgctggggcgttagtcttctttcggcaaacattgcaagtggccgtggcgcacgccgcgctgggcgataacatcatcggcaaaatgctgtacgtcgcccatatcgcccttcagaacggcgatctccagacagtcatcgtggttgatatggacgtgcagcgtggcgacggataaatcatgatgatgatgctgggtggagacgatgcggctggctaaatcccgtttctcatgttcataaacatatgaaagtaccgcgaaaccctgtgtaccgtgttcctgggtggcctcctgcgccagagcgccgcgcagaatatcacggatcgcttcggagcgattgttatagccgcgtcgctggctcaggctgtccagcgtttccagtaaatcgtcatcgagggtgatggtgacacgttgcatctgacttaaaccttttggtatggcgcgtcggcgcatgggaagctccgcattttgtaacacacgtccgccgccagagggaaaattaatgtgtcataacgcttttgttatcgtctgcggcgtcagcgtaaacggtgtgggggtacagactgccagactgagcgtatcgagctgacactggctgaccgacaaggcagagggcaacgtgctgtccacgctgacgatttgccaggcgctgccgccgcgttgttttacgatggcttctttacgcgtccagatacgccagaaggccgccagttgtcgctccggacgttccgcttccatttcagcatgttcgccgaggctgaataccgcatttgccagcgaacgccagttatcgcgcgggcggatcacttcaatatcgcagccgacttcaccttcgtcgctaagcaacagagcaatagtgtcgccgctatggctgaggttaaaccacagcggcgttccggcggaaaaagccggtttaccctgttcgccatacaccatctccggtagcggcgagagcgcacgggaaagcagcacgcgcccggccagccagcttgcccggcgaacgccctgcggcgcctgagcgattaacgcgtcgggcaattgacctgcgcttaatgttgacacttttcccagaacgatctggtacatatcaggaccaacgttgcctatgaagaagaggagattgtagcatctgtcgcctcatcccggtaaacggcttttcggtcggcctggccccagtaagatcgccagtttgctgccgcctttagtggtttccatccagattttgcagacgctggtcaaaggaacggacaagagcatcccgaccgggcctaatagccatccccagaccagtaacgaaagaaataccaccagcgtggacatccccagacgatggcccatcatgcgtggctccataatgttgccaatcaccatatgaaccaccaaaaagagcgcgccgaccagtacgcattcgtaaaagccgttaaataacaacgcctgaatcatggggggaacggcggaaatcaccgagccgatattaggaacgtaattgagcaaaaaggccagtacgccccacattagcgcaaactgaatatccattaatgccagccccagccagataatcgcgcccgtccatagactgagcagcgttttcagcgccagataatgcgagacgcctttcagggcgcggtgcaggccggcaatatggatttgtggattgttaagcgcgaaacgtaatttataaggcacgtgacgcacctcaaacagcataaaaaccacggtcatcaccagcagcacaatgcttgccatcgcgcccgatacgccggtcattaatgttgtggtgaagagcatgattttatcggaatccatcccacggagcatacgttccggcgacatatgtaaattcaggaagggcattaactcctgaagatgtaaaaccttacgcgtcagctccttgctgtatttaggcagcatagcgataaattcattaagcgatgcggcaagcacacccaccagcgcggtaagcacgatcagcatgacgaccaccacgatagtaatcgccagcggtcgcttcacgccccggcgaataaaccaggtcactaatggattaagaacgatggcgaaaaagagcgccagtaagagttgtacaataatatccgccgcggcatgaatcccggcgagaataataaccagggaggccagtttcagcagaatatgcatacccgttttgtcgggttgagcggttgccatgaagttttccttgttgtgtttttttctaagtgtagcggctgccctgataccgataatctgaatctcactactgattttcaccgcgcgccatgatagaaaagaaaacatgttgtaaaaatgcggtgatactcatgcccgaacccgtcgctgaaccggcgctaaacggattgcgcctcaatctgcgtattgtctccatcgtgatgtttaactttgccagctacctgactatcggcctgccgctcgccgtcttgcccggctatgtgcatgatgcgatgggattcagcgcgttctgggcggggcttattatcagcctgcaatacttcgccactctgttaagccgtccccatgccgggcggtatgcggatgtattagggccgaaaaaaatcgttgtctttggcttatgcggctgttttttaagcggactcggctacctgctggcggatatcgccagcgcctggccgatgatcaatttgttgctactggggctgggtcgcgtgattttggggattgggcaaagttttgccggcaccggttcgacactgtggggcgtcggcgtcgtcgggtcgttgcatattggtcgggttatctcctggaacggtatcgtcacctacggcgcaatggcgatgggcgcgccgctgggcgtgctgtgttatgcctggggcgggttacagggactggcgctaacggtgatgggcgtggcgctgttggcggtactgttagcccttccacgtccgtcggtgaaggcgaacaaaggcaagccgctgccgtttcgcgcggtgctggggcgtgtctggctgtatggtatggcgttggcgctggcctcggcagggtttggcgtcatcgcgacgtttattaccttattttatgatgctaaaggttgggatggcgccgcctttgcgctcacgttatttagcgtcgcgtttgtcggcacgcgtttgctgttccctaacggtatcaatcgcttaggcgggttgaatgtcgccatgatctgctttggcgtggagattattggtctgttactggtggggacggcagccatgccgtggatggcaaaaatcggcgttttactcacggggatggggttttcgctggtctttccggcgctgggtgtggtggccgtcaaagccgtgccgccgcagaaccagggcgcggcgctggcgacctataccgtctttatggatatgtctttgggggtgaccgggccgctggcggggctggtgatgacctgggcgggcgtgccggtgatttatctggcggcggccgggctggtagcgatggcgctattactgacctggcgcttaaaaaaacggcctccgtctgcactgccggaggccgcatcatcgtcgtgaaggttacttaataaccaacgtattgatgatgttttcagctgtggtttgcgctttttgctgattgtccgcaggcagcgtgacctgaatcgtcagcaattggttatccactttgcccagcacgatggaagagtacgccgtctggcctttcgcggagataatgctgtccagctgttgcaacgtatggcctttgagctcaatagacttattggtgacgacctgaagctgcgggtcgcggctacgctgttgctcaagcaggcggttcgccagcaccggcaacgcttcatcggtattatcgccgacgataacaatcaccgctttctggcccgtcgggtcagaataaacgtgcatattattcgcctgggtgcccagcttaccgctttgatcggtcatatccgccggcagtgagaaactgagtttgccatccatcaggctgatgggctgaccggaggcctggctttctgcggcggcgctttctgccgacgcttttgtatcgttgttatcacaggccgcaagccccataaccagcaggccaataccggcatatttaaccaaattgcgcattgacttcttcctttcgataaacggccataacggctcattcgctcatcttatcacaactcggaaaacgaacctttaacttgccggtaatggggaaatttcagatttatctgccagctttttcagcaacatattcagtagaacgccgtacatcggcaggaagaaaataatgctgatgagcaccttaaagcaataatccaccagcgcaatttccatccagtgcccggccataaaggcatcggggcttcgccagaacgcaatgaagaaaaaggcaagggtatcgctgatattgccaaacagcgttgaagcggtcggcgccagccaccagcgacgattttggcgcaggcggttaaacacatggacatcaaggatctgtcccagcgcgtaggccataaagctggcggcggcgatacgggcgacgaacagattaaagttcgccaacgcggcgaaaccttgccaggcacccatatagaacagcgatgacaccacatatgacaccagcagcgcagggatcatgacggcgaagataatgcggcgcgccagcggtgcgccaaaaatacgcacggtaagatcggtggcgagaaaaataaaaggaaaactaaacgcgccccaggtcgtgtggaaaccaaaaatagtgatggggagctgcaccagatagttactggaaatgatcaccagtaaatggaatagcgatagccagaacaacgcttttatgcgctgtgattgtgtaaacggagtcatattgtgacctttttgttggatggggtgagggaacccaataaagaaccgccgcataatactgttttgcgctggcattgcaatggctaattttcacgcaatcgttaacctgcttggcttactgacgaagatgggcgtaaaatatcgccgtttttctaccattgagacgaagatgagcgatctgttttcctcccctgaccatacgcttgacgccctggggctgcgttgccctgaaccggtaatgatggtgcgcaaaacggtgcgcaacatgcaaactggcgaaacattgctgattatcgccgacgatccggcgacgacgcgtgatattccggggttctgtacctttatggaacacgatttgctggcgcaagagacggagggtctgccgtaccgctatttattgcgtaaagcgcattaaccgcacggcagatagcattctgattagaagctttcccagttcgcctgttctgcggcgggctgtggcgttaagcctttgcttaacggcgtcggcgacgcctcccgacgaggttgtttctggatgcggaacgcggcgaccgcctgacgaagctcgttagcctgatcttccagcgccgccgctgctgctgcggattcctctaccagcgaggcgttttgctgcgtcacgctgtccatttccgataccgcctgcgccacctgctcaatgcctttgctttgctcatcggaggcagaggcgatttcgcccataatatcggtcacgcgggtcacggcgttaacgatctctttcatggtttctcccgcttcgcgtacctgcgtagagccggtatcaatgcgcgacacggagttttcaatcagcactttgatctctttggcggcctgcgcgctacggctggccaacgtgcgtacctctccggccacaaccgcgaatcctcgcccctgttcgccggcgcgggcggcttctaccgcagcgttcagcgccaggatattagtctggaaggcgataccgtcaatcacgctggtgatgtccacgattttttccgagctttcggcgatatcgttcatggtgctcactacgttatccaccacgcgtcctcctttacgcgcggtttctgatgcggttttcgccagacccgtcgcctgtcgtgcgttatcggtgttttgccgtaccgtggcggttaactgttccatgctggcggcggtctcctccagcgccgaggcctgctgttcggtacgggaagagaggtcgctgctgccagcggaaatttcgcctgcgccagtatagatagagtctgcgttatcgcgcaccgcgctgacggtacggattaacgactgctgcatcgttttgagaccggcagccagttggcccatttcactacgtccttcagcctctatctcatgggtaagatcgccgtcggcgatcgtttgaatgtgcgccataatccgttgcagcgggcggagtagaacgcgttgcagccccagccagataaacgccagcacgatgagcacgataagtagaattatccccagcgtccattgcatctgggtaaaactgctctgattctgatcgctggctaattttattaattgcgcattttgagagagccactggtcatatacctgctccatgtcatcctgcgctttttgcgcgtcaaggttgccataggcggcgtaattatcggctttaagatagtggatagactgctgcaaaacgtcatacatctgcttaaagctggcttcggcctgggcatccaacgccggatctttgcctgcgatcgcttcggagttcacgtagttgttgaaatgcttttccgcttcgttgagcgacgcgccagcgttggttaacagcgtgttcatggcgtccagcgaggcgggatcgcgctgattttttaacatgcgtatcgccacgcggttaatggtgacgcgggtttcaatcaatgtctgaaaactgccgcccagttcctgttgttggtaactcagtgcgctcgcattctggaaattcagccgatcgctgctgacggcggaataaaacagtattcctgtcaccaacaataaggcgctaaatatgcccagcgtcgcgataacgccggtgatgactttgatatttttcatagtgcctaacattccttattttgtagacggtatgatcaatatcggttggataaaaattaaccttacatcaaatcgcgctatttctgattaatggtttgataagtaatagaaaataaatgattttcgcgtgaataatatgtacaaagaaaggaatatcgcgggataacccggcgacatgccgccgggtgggagaagattagtttttacgcagcaaacgtagcgcgttggcggtcactaataccgtggctcccgtatccgccaggattgccagccatagcccggtaaaacccagtagcgtcgtcaccaggaaaatggctttcagccccagcgcaatggtgatgttctgccggatattcgcgtgggtagcgcgcgccagcgtaatcatctgcgctaacccgcgcagacggttatgagtaagggcggcgtcagccgtttccagcgcgacgtcagtaccgctgcccatcgcaattccgatactggcggctttcatcgcgggcgcatcattaatgccgtcgcccaccatcgccagcggcgcttgttggttaagggcggtgactgcccgcaccttatcttccggcagtagtccggttttaaacgccagatccagctcgccggcaatcgctgccgccgcccgtgggttatcgccggtcagaatcacgccgttaacgcctaactgatgcagttcgcggatggcgtcgcgcgcatcgtcacgcaacgtatcctggagggcgaggacgccaacaacggtctcgttacgtagcaccagaaccaccgtctgcccggcgttttccagttcgctaatttgcccggcaaacgctgccgcaggctgttttcccgccgcgcaaatcagaatacgttcgccgttaacctgcgcttcaatcccggtgccggccagcgttcgctgcgattccgccgtcgggatcgccagatcgcgtgtctgcgcttcgcggacaatagcctgcgccagcgggtgcgtagcgccttgttctacggctgccgccagcgccaacagttcagcctcgctgataccgcttgccggatgaatcgccgtcacccgtggtttaccgatggtcaacgtaccggttttatcaaaggcaacctgcgtgatacggcccagttgctccagcgctgctccgcctttaatcaatgcgccgcgccgtgccgccgccgccagcccggaggtaatggccgcgggcgtggagatcaccagcgcgcacgggcaaccgattaatagcagcgtcagccctttataaatccactcctgccagccgccatcgaacatcagcggcggaataagcgtcaccagcagcgcgatgaccataatgactggcgtatagatgcggctgaaacggtcaataaaccgctcaatgggcgcacggcgctcttccgcctcttcaatcagcgtcaggatacggtcaatcgcgctggcgccaggttcagatagcacctccagggtgacgagacggtcaacgctggtcgcgcctgccgggactttgtcgcccgttgcgcgctccacagggatagactcgccggtgagcgcgctttcatcaaagctggcgaaaccggaaaccagtttaccgtcggcgggtaaacgccccccggcggcgacttcgataatatcgcccggtcgcagggtattaatagcgacctcttcccgcacgccgtcgcgcagacgggtcgccgtttccggtttaagcgccattaacgcgctgacgcctttacgggcgcggctggcggcccatccttccaggcgctcgccgatgaggaacagcagcaataccattgctgcctccgccgtcgcgcctataaacagcgcgccaatggcggcgacgctcatcagcgtttcaatagcgaaccaactgccgcttttcatcagccgcagcgcctggcgggcaataggatacagaccgaccagagtggtgacgataaaggccagttggccgaacgggtggttaaattgctccagcccccagcttatcgccatcataatgatcagcgtaataagcggcaggttctctttaagacgagattcaggcgcggcgtcgcgcgaatcttcactacgcaaggtataacccgccttctgtacggcgtgttcaatttgcgcgcggaggtcggtgtcggcatcgaccactaacttttcggtggcgaacagcacttgcgcctggttgacgccgcgaatttggcgtaccgcattctccacttttcgggcgcaggcggcgcagtccatgccggagattttccaggtatagcgcgtgcctgccacggcagtagaaacaggcgcgctggacgcgcaatgttcttcgcagcagcagctatcggccttctgtattgccggggctaatctgaaggaggtaaagggcgggacttttttgccatcggtatcaggggtcgacataacgtcctccggttgatgataattttctcattaaccggaggatacactctggagtcgactccagagtcaagcgctattatttacaggtacagcgagcgaacaatcaggaagtgtcctgcaaagtagcaggcggcggcaatcgcgttatccgcccggaaacggcggcggtaatggctacccagccagacgatattgccgatgaacagcagcgtcgcgccggtaaaggccgaaagggctggcgccgttgggcggaagaaccacagttcgcccgccagccagaccatgaccagcgtcatggcgataaaagtacataccggccagcgtagctcctccagtcgcgtccagataacggcgataagcaacgcgccgactatcagtaacgccagcggcagcggccagaagaacgacaacgtcatttggctggcaaagtaaatggtgtagagcagatgcgataagaaaaatgccccgacggcgtacagcaggcgttgacgcggtaagagcgttaacgcatcgccgaccagcgaggcgcacagtccggccaacacaagataactgatggcgtcaaacatcggcgcttgccaggccagtaacagcaacagtaataacgtgacgggcttaaaaacccagcgttgccaggctggcccgcgataggaggcgtccacatacagccatgcggacaggcagacagcgataaacgaccaaagcatcttaattccttgaattcgttattttttcgcaaacggtatgcttgcggctctattattcagtgtagaggccgtgacggtcagatgacaacactataacgggcagggtatgcttatttccgcattttctgacaggttaacagtatgagtaagccaccgcttttcttcattataatcattgcattaatcgtagttgccgcgtcgttccgcttcgttcagcaacggcgggaaaaagccgctaatgaggcggcgccgttacagcaaaagcaggtcgtggtcagcaataaacgggagaagccggttaacgaccgacgctctcgccagcaggaagtgagcccggcgggaaccagtatgcgctatgaggccagttttaagccgctcaatggcggtctggaaaaaacgttccgtttacaagcgcagcagtaccacgctttgacggtgggcgatcaaggtacgctaagctataagggaacgcggttcgtcggatttgttagccgtaccccggataacgaataaaccgtcatccggcagcaaacgttattttttgttcttaaacttcttctgccagaccagcagctcaaacacgctgaacaggaaaatgcggattttctctcccgtcgtcatctgcggacccgctttcggtatcgttgatttcagcaacgccaactgcataccgtgcatcagcgccatgaacaccaacgccacgttgacgaagatattgagcgggcgcgggaagggatgcaccagattaagaatcaaaaatgcccacacgaagagcattaataagcggcccagattaatcaacatcattttctccttgcgcgtcgcgctgatacagacgataagcgacctgtccggccaccttttctcgatacaatgcccagttcgccggaacgggcggcagaccgttttccacctcgctttctacgtagattagcgcgtcgtcggccagccatccctgggtttctagcaattgtaacgtctcttccagcagtcctttacgaaacggcgggtcgacaaagacgacgtgatgcggcgtccccggctggctgaggaaggccagagtattggtattgacgacgcgagcattgttggctttcagcgtcgccagatttttttgcaactgctgcgatacggcgcgatccatttccagtaacgttgcctgggccgcataacgcgatagcgcttccagacccagcgcgccgctgccggcaaagcaatccagacaatgggcgtctaccattaccggagccagccagttaaataacgtttcgcgcacgcgatcggtggtaggacgcagacccgggctgtccggaaccggtaatttacggccacgccattgcccgccaataatgcggatttggccgctgccagagtgagtcggttttttcatttctcttgctcgaaccgcctgttgcaagttattccaggcggtgatgtgaattaagttaagtgatagactatttcatcatttttttagcttccatgtatatagcgccgcgaggggtgtagtcgcagatggcaaaacagaaaaaacgtggcttcttttcctggttgggcttcggtgataaagagcagaagcaggaacagaccgaagaacagcagattgttgaggaacaacgaccggttgagccccctgttgaaacggcggcagacgtagacgcgcaaacgcccgcgcacagcaaagcagaaacagaagcctttgcggaagaggtggtggacgttactgagaaagttcaggagagcgaaaaaccgcagccggtagagccggagcccacggcggccattgagatggcagcgccgcagatcgcggtggaacgcgaggaattgccgctgccggaagaggtcaaagacgaggctatctcgccggaagagtggcaggccgaagcggaaaccgtagaggtcattgccgcggtagaagaagagggcgaaaacgcggcgaaattcaccgacgaagagctggaagcgcaggcgctggccgctcaggcggcggaagaggcggtgatggttgttccgccggcggaagaagacgcgccggtggaagcgatcgttcaggagcaggaaaaaccgactaaagaaggtttctttgcccgcctgaaacgcagtctgctgaaaaccaaagaaaatctcggttccggatttatcagtctgttccgcggcaagaaaatcgacgatgatttgttcgaggagctggaagagcagttgctcatcgctgatgtcggggtggaaaccacgcgtaagattatcgctaatctgacggaaggcgccagccgcaaacagcttaaagatgccgaggcgctgtatggtctgttgaaagacgagatgggcgagattctggcgaaggtagacgaaccgcttaatattgaaggtaaaacgccttttgttattctgatggttggcgtgaacggcgtgggtaaaaccaccactatcggtaaactggcgcgccagtttgagcagcagggtaaatcagtgatgctggcggcgggggatactttccgcgcggcggcggtcgaacagctacaggtctggggacagcgtaacaacattccggttatcgcccagcataccggcgcggactccgcctcggtgatttttgacgctatccaggccgcgaaggcgcgtaatgtggatgtgttaattgccgatacggcagggcgtttgcagaacaagtcgcacctgatggaagagctgaaaaaaatcgttcgcgtcatgaaaaagctggacgaagaagcgccacatgaagttatgctgaccattgacgccagcaccggacagaacgcggtaagccaggccaaactgttccatgaagcggtgggcttaaccggtattaccctgaccaagctggacggtacggcgaaaggcggggtgattttctcggtagctgaccagtttggcattcctatccgttacattggcgtgggcgaacgtatcgaggatttgcgtccgtttaaggcggacgattttattgaggcactttttgcccgagaggattaacaatgattcgctttgaacatgtcagcaaggcctatctcggcgggagacaagcgctgcagggagtgacattccatatgcggccaggcgagatggcgtttctgaccggccactccggcgcggggaaaagtaccctgctgaagctaatctgtgggattgagcggcccagcgccggcaaaatcttcttcagcgggcatgatattacgcgcctgaaaaaccgcgaagtgccgtttttgcgccgccagattgggatgattttccaggatcaccatctgctgatggatcgcacggtctatgacaatgtggcgataccgttaatcattgccggcgccagcggcgatgatatccgtcgtcgtgtgtcggcggcgctggataaggttggactactggacaaagcgagaaacttcccgattcaactctccggaggcgaacaacagcgcgtgggcatcgcccgcgcggtggtcaataagccagcggtattgctggcggatgaaccgaccgggaacctggacgacgcgttgtcggaagggattttacgtctgtttgaagagtttaaccgcgtaggggtgacggtactgatggcgacgcacgatattggacttatctcgcgtcgttcctataggcagctcgtcctgagcgatggacatctgcatggaggcctggccaatgaataggcgcgacgcgattaaccaaatcaggcagttcggcggacggctggatcgactgcgtaagtctcgcggcggaacaggcggcgggcgcaacgcgccaggacgccagaagccgacgccgaaaccgaactcacgtaaaacaaatgtttttaatgaacaggtgcgctatgcttggcacggtgcgctgcaagatctgaaaagcaaaccgctggcgacgtttctgacggtgatggtgatcgccatctccctgacgctgcccagcgtctgttacatggtctataagaacgtcaaccaggcggcgactcagtactatccgtcgccgcagatcaccgtttatctgcaaaaaacgctggatgatgacgcggcggcgcgggtcgttgggcagcttcaggccgagcagggcgttgagaaggtcaactacctgtcccgtgaggacgcgctgggcgaattccgcaactggtcgggttttggcggcgcgctggacatgctggaagagaacccgctaccggcggtggcggtggtgatccccaagctggactttcaaagtaccgcctcgcttaatacgctgcgcgaccgtatctcgcagattaacggcattgacgaagtccgcatggatgatagctggtttgcgcgtctggcggcgctcaccgggctggtgggccgcgtgtcggcgatgattggcgtgctgatggtcgcggcggtcttcctcgttatcggcaacagcgtgcgcctgagcatttttgcccgtcgcgacaccattaacgtgcaaaagctgattggcgcgaccgatggctttatcctgcgtccgttcctctacggcggcgcattgctcggtttttccggcgcgtttctttcactgatattgtctgaaattttggtgatgcgtttatcatcggcggtgactgaagtggcgcaggtcttcggcacgaagtttgatctcaatggtttatcgttcgatgagtgcctgttgctgctgctggtctgttccatgatcggctggatcgccgcttggctggctacggtgcaacatttacgttactttactcccgattgataaaatcgtggtataatctttccctgcaatgggcttccgttcgcagggaaagagtccctgttgtctcttccccgcgtttcatcttcatgtcacattatgtgtgtaaattatgcacagtgttacattgaacttgtggataaaatcactgtctgataaaagagtggatgatattctcgttgctcatcggctttggcacggttgttgctcgctgacggtgccaggcaatactgattgagaggatttgaatgaccaaagaaatgcaaaatttagctttagcccctgttggcaacctggaatcttatatccgggcggcgaacgcgtggccgatgttatcggctgacgaggagcgggcattggctgaaaggctgcattaccagggcgatctggaagcagctaaaacgctgatcctgtctcacctgcgctttgttgttcatattgctcgtaactatgcgggctatggtctgccgcaggcggatttgatccaggaaggcaacatcggcctgatgaaagccgtacgtcgtttcaacccggaagtaggcgtgcgcctggtctccttcgccgtacactggattaaagcagaaattcacgaatacgtgctgcgtaactggcgtatcgttaaagtcgcaaccacgaaagcgcagcgtaagctgttctttaatctgcgtaaaaccaagcagcgtctgggctggtttaatcaggatgaggttgaaatggtggcgcgcgaactgggtgtttccagtaaagacgtgcgtgagatggagtcgcgtatggcggcgcaggacatgacgtttgacatgtcttcggacgatgagtccgacagccagccaatggcgccggtgctgtatctgcaggataaatcgtctaactttgccgacggcattgaagacgataactgggaagagcaggccgctaaccgactgaccgatgcgatgcaggggctcgacgagcgtagccaggatattatccgcgctcgctggctggacgaagacaataagtctacgttgcaggagctggccgatcgttacggcgtctccgctgagcgtgtgcgccagcttgaaaagaacgccatgaaaaagcttcgcgctgcgatcgaagcgtaatcttcgcgaattgccaatgaaccctcgaatgtgaattcgggggttttgttttttgtaggccggataaggcgtttacgctgctatccggcaacacgtttgcccgatgtcgcttcgcttatctggcctacgggcccttcctctcccccaccgacacaaatctgttatctggatgtaaatttagctattccaaaataataaaaatcgggtatgttttagcagagtatgctgctaaagcacgggtagctagccaataatcgaaataaagtgctgaacaataacaccacaacacacgtaacaaccagaataatggggattatcaggatgaatatgaagggtaaaacgttattggcaggatgtatcgccctgtcattaagccatatggcattcgcagaggacattaaagtcgcggttgtcggcgcgatgtccggtccggtggcgcagtatggcgaccaggaatttaccggtgcggagcaggcaattgccgatatcaatgcgaaaggcggtattaaaggcgataagctcgtcgcggtgaaatatgacgacgcctgtgatccaaaacaggcggtagcggtcgctaacaaagtggtgaacgacggcatcaagtatgttatcggtcacttatgctcctcttccacacagccagcgtctgatatctacgaagacgaaggcatcctgatgataaccccggcggcgaccgcaccggagctgaccgcgcgcggctataacctgattttgcgcacgaccggcctggactctgactagggaccaacggcggcaaagtatattctggagaaggtaaaaccgcagcgcatcgcgattatccacgataagcagcagtacggcgaagggctggcgcgcgcggtgcaggacggtctgaagaaaggcggcgttaacgtcgtattctttgacggcattaccgccggcgaaaaagatttctccactctggtagcgcgtctgaaaaaagagaatatcgactttgtctactacggcggttatcacccggaaatggggcagattttgcgccagtcccgcgccgcagggctgaaaacccagtttatggggccggaaggggtggcgaacgtctcgctgtctaacatcgccggagagtcggcggaaggcttactggtcaccaaaccgaagaactacgatcaggtcccggcgaacaaaccgattgtggatgccatcaaagccaagaaacaagatcctagcggcgcattcgtgtggaccacctacgccgcgctgcaatcgttgcaggcgggtctgaaccagtctgacgatccggcggaaattgccaaatacctgaaaggcaccacggtcgacaccgtaatgggaccgctgtcgtgggatgagaaaggcgatctgaaaggatttgagttcggcgtgtttgactggcatgcgaatggtgcggcgacagacgctaagtaattttcctggcgcctttcgcgctgcaggtgcgttggctacgttattcaaccccggtcacttacttatgtaagcttccggggatttcataacttgccgcctgcctgcaacgcgaaattcttggaaaattgcgaggtggtttttatcttttctcccggcatgtaggccggataagcgtcagcgccatccggctttcttttagcgcttctcccagccgtcatgctgggcggtaaaacctaacgcctgcataaacgcggccatcacgctgcggtcttcaacaccgacatccgccatccaccacgacgagacgttgggattatcgcggatgacctcttctaccaggtattgcccgacgccgcggcgacgggtgatttcacgcacgcgtaaggaatccagcgcgccctgcgttccgctcagcgtcactcttacggcgcccaacaaacgctcgttaaaccgcgcggcataaatccggtgcgtttcatctacgcttaatgaggaggcggaatattccggccagattttgcccagatcgatctgatcctgagcgctaaagtgttctaaacgaagaatggtcagcttcatcgacggcttgtcccgatttcaaaagatgcgatcagtgtaccgaaacaggcaggccagatgctttctcttttttgtgtcatttaccaggttattaattttttaacaacgataattacagtttgaagcattagagaatggaaaacaggcagcataattccctgaatgctagtgaattattccgcttaatgtgccgttattttatgctgacaagcgtgcttttttttgtttatctataacgaaaagcagaatattatattttcttaatagactgaaaaatagagattttaatcttattatgctttaaatgctgcgctaactcattaatgagtcagtaaaaagcgcaccatttataaaaagtacagtctgctttttaaccagtaaaaaacaaaacatataacatcacgaatggggatacaggcacatgaaacggaaagcgaaaacaataatcgcagggattgttgcattagcagtctcgcagggggcaatggcagatgatattaaagtcgccatagtcggggcgatgtccggcccggtagcgcaatggggcgatatggaatttaacggcgcgcgccaggccattaaagacatcaatgctaaaggcggtattaaaggcgataagctggtcggcgtagagtacgatgatgcctgcgatccaaaacaggcggtggcggtggccaacaaaatcgttaacgacggtattcagtacgttattggtcacttgtgttcttcttctactcagccagcatccgatatctatgaagatgaaggtattctgatgatctccccgggggcgactaacccggagctgacccagcgcggctatcagtacattatgcgtaccgccggcctggactcctcccaggggccaacggccgcgaaatacatcctggaaacggtgaaaccgcagcgcatcgctatcattcacgataaacagcaatacggcgaaggactggcgcgctccgtgcaggatggcctgaagcagggcaatgccaatattgtcttttttgatggtattaccgccggcgaaaaagatttctccgccctgattgctcgcttgcaaaaagagaatatcgactttgtgtattacggcggctactacccggaaatggggcagatgctgcgccaggcgcgggctaatggcctgaaaacgcaatttatggggccggaaggcgtgggtaacgcgtcgctgtccaatattgcgggcggtgcggcggaaggcatgttggtgacgatgccaaaacgttatgaccaggacccggcgaataaagcgattgtcgaggcgctgaaagccgacaagaaagatcccagcggtccgtatgtctggatcacctacgccgccgtccagtcgctggcgaccgcaatgacgcgtagcgccagccatgctccgctggatctggtgaaagatcttaaagcgaacggggctgataccgttattgggccgctgaaatgggatgaaaaaggcgatcttaagggatttgaatttggcgtcttccagtggcacgccgacggctcgtcaaccgtcgcgaagtaatgccagaagataagttatcccaccgcccgcacgccgggcgggtttaaaaaggttaccttatgtccgagcagtttctctatttcttgcagcagatgtttaacggcgtcacgctggggagcacctacgcgctgattgctatcggttatacgatggtgtacggcattatcggcatgatcaacttcgctcatggcgaggtgtatatgatcggcagctacgtctcttttatgatcatcgccgcgctaatgatgatgggaatagacaccagttggctactggtggccgccggatttatcggcgcgattattattgccagcgcctacggctggagtatcgagcgagtcgcttaccggcctgtgcgcaattccaagcgcctgatcgccctgatttccgccatcgggatgtccatctttctgcaaaactacgtcagcctgacggaaggttcgcgcgacgtggcgttacccagcctgtttaacggccagtggattgtgggcagcagcgaaaacttttccgcgtccatcaccaccatgcaggcggttatctggatagtcacctttctggctatgctggcgctcaccattttcattcgctactcccggatgggccgcgcctgccgcgcctgcgcggaggatctgaaaatggccagcctgctcggcattaataccgaccgcgtcattgcgctaacgtttgttatcggcgcggcaatggcggcggtggcgggcgtgctgctcggtcagttctatggcgtgattaacccctacatcggttttatggccgggatgaaagcgttcaccgcggcggtgctgggcggtattggcagcattccgggcgcgatgatcggcggtctgattttgggcgtcgccgaagcgctctcgtctgcatatttaagtaccgaatataaagatgtcgtgtcgttcgctctgctgattctggtactgctggtgatgccgaccggtatcctggggcgtccggaggtagagaaagtatgaaaccgatgcatattgcgatggctctgttctctgcggcgatgttcttcgttctggctggcgtctttatgggcgtacaactggagctggacggcaccaaactggtggtggataccgccgccgacatccgctggcagtggatctttatcggtacggcagtggtttttttctttcagttgctgcgtccgatgttccagaaagcggtgaagcacgtctccggaccgaagtttattctgccggcgatcgatggctctaccgttaagcaaaagctgtttctgatggcgctgttggttatcgccgtggcgtggccgtttatggtgtcgcgcggtagcgtcgatatcgccactatgaccatgatttatatcatcctcggtctggggctgaacgtggtggtggggctgtccggcctgctggtattgggctacggcggcttttacgccatcggcgcttatacctttgcgctgcttaaccactattacggtttgggtttctggacctgcctgccgctggcgggactggtctccgccgccgccggtttcctgctcggcttcccggtactgcgcctgcgcggcgactatctggcgattgtgacgctcggcttcggcgaaatcgtccgtatcctgttgctcaacaacactgaaattaccggcggcccgaacggcatcagccagatccccaaaccgacgctgtttggtctggagtttagccgcaacacccgagaaggcggctgggataccttcagcaatttctttggcgtgaagtacgacccatccgaccgggtcattttcctctatctggtggccctgttgctggtggtcctgtcgctgtttgtcattaaccgcctgctgcgtatgccgctgggccgggcgtgggaagcgttgcgtgaagatgagatcgcctgtcgctcattaggtttaagcccgacgcgcatcaagctgaccgcttttactatcagcgccgcgtttgccggtttcgccgggacgttgtttgccgcccgccagggctttgtcagcccggaatccttcactttcgccgaatccgccttcgtgctggcgattgtggtgctgggcggaatgggctcgcagtttgcggtgatcctggcggcggttctgttggtggtgtcgcgcgagttgatgcgcgatttcaacgaatacagcatgttgatgctcggcggtttaatggtgttgatgatgatctggcgcccgcagggattgctgccgatgacgcgtccgcagttgaagctgaaaagtggtcaggcgaaaggagagcaggcatgagtcagccattattagcggttaacggcctgatgatgcgctttggcggtttgctggcggtcaacaatgtatcgctggaattgcgtgagcgggaaattgtgtcgctgattggccctaacggcgcgggtaaaacgacggtgtttaactgcctgaccggtttttataagccgacaggcggtacgatcacgttgcgcgagcggcatctggaaggattgccgggccagcagatcgcccgcatgggcgtggtacgcactttccagcatgtgcgcctgtttcgcgaaatgacggtgattgaaaacctgctggtggcgcagcaccagcaactgaaaacgggcctcttttccggcctgttgaaaacgcccgctttccgccgcgcgcaaagtgaagcgctggaccgcgcggcgacctggcttgagcgtattggcctgctggaacatgccaaccgccaggccagtaatctggcctacggcgaccagcgccggctggagattgcccgctgcatggtgacgcagccagaaattctgatgctcgacgaaccggcggccggccttaacccgaaagagaccaaagagctggatgagctgattgccgaactacgtaaccatcacaacaccactatcttgctgattgaacacgatatgaagctggtgatgggcatttccgatcgcatttacgtggtgaaccagggcacgccgctggcgaacggcacgccggaagagatccgcaacaacccggacgtcatccgcgcttatctgggtgaggcataagatggaaaaaacgatgttaacgtttgaaaaagtcagcgcccactacggcaagattcaggcgctgcacgacgtcagtctgcacatcaaccagggggaaatcgttaccctgattggcgctaacggcgcggggaaaacgacgctgcttggcaccttgtgcggcgatccgcgcgcctccagcggacgggtggtgtttgacggtaaagacatcaccgactggcagacggcgaaaatcatgcgtgaagcggtggcgatagtgccggaagggcggcgcgtcttctcgcggatgacggtggaagagaacctggcgatgggcggtttttttgccgagcgcgatcggtttcaggagcgtatcaaatgggtgtacgagctgtttccgcgcctgcatgaacgccgtatccagcgagcgggcaccatgtccggcggcgaacagcagatgctggcgattggtcgcgcgctgatgagccagccgcgcctgttgctgctggatgaaccgtcgctggggctggcgccgatcatcatccagcagatcttcgacaccattgagcagttgcgcgagcagggtatgaccatcttccttgtcgagcaaaacgctaaccaggcgctgaagctcgccgaccgcggttatgtgctggaaaacggccacgtggtgctatccgataccggtgatgcgctgctggcgaacgaagcggtgcgcagcgcctatctgggcggataaggcgcagtttacagctgccatctggcaaacgcgcccggtggcgctaccgcttaccggacctggcggattactcggcattcggcaaatcagtagaacatttttcgtaccaatatgttatagttgagaatagttatcaactataaccaccgaagaaggagcaaggatgatacgttcaggcgcctgcataatgggaacgctgttgttcgcggcttcgttcagtgttaacgccttaacctcaaacgattttgatccccgcgatcctgctatctggcaagaagaaaccgcaacgccttatccactggccgcaacgacctgcgaagtgcgtcatcatccggattgtgcaacgtgggaggatgaaaaatccgacattcagcgtgaacgcgagcggcgagatcagcggcgcttacaaaatctgtacaaaaagtattctcatcgtgattaactgctgacgccagccaaataacgcatgtctggtcagcattacgctgtcagacgtgccgtagctcccacttttcttttccggcgctttcactgccttgccatctctctgtcgccttactatctttttttgtaataaaaaagttatttttctgtcattcgagcatgtcatgttacccccgcgaacataaaacgcgtgatatcgcgcatcccggcacaaaaagagagataaccgatgatatcgttacgacatacagctttaggactggcgctgagtctggcatttacgggtcaggcgttggccgtcaccactattccattctggcattcaatggaaggggagttaggcaaagaagttgattcactggcgcaacgtttcaaccaggccaatccggattacaaaatcgttccggtctataaggggaactatgaacagaacctgagcgccgggatcgcggcattccgtaccggcaacgcgccggcaatattgcaggtttatgaggttgggacagcgaccatgatggcctcgaaagccattaagccggtttatgaagtgtttaaagacgccggtattaactttgacgagtcccagtttgtaccaaccgttgcaggctactacaccgatgctaaaagcgggcatctgctctcccagccctttaacagctccacgccggtactgtactacaacaaagacgcctttaagaaagccggtttagatccggagcagccgccgaaaacttggcaggagctggctgactataccgcgaaattgagagcggcaggcatgaaatgcggttacgccagcggctggcaaggctggatccaactggaaaacttcagcgcctggaacggtctccccttcgccagtaaaaacaatggctttgacggtacagatgcggtgctggagtttaataagccagagcaggtgaaacatatcgcgctgctggaagagatgaataagaaaggcgattttagctatgttgggcgtaaggacgagtctaccgagaagttttataacggtgactgcgcgatgacaaccgcgtcctccggctcgctcgccaatatccgccagtatgccaaatttaactatggcgtgggtatgatgccgtatgacgctgatatcaagggcgcgccgcaaaacgccattatcggcggagccagcctatgggtcatgcagggtaaagataaagaaacctataccggcgtcgccaaattcctcgacttcctggcaaaaccggaaaacgctgctgaatggcatcaaaaaaccggctacctgccgattaccaccgccgcctacgagctgacccgagagcagggttattacgataaaaaccccggtgcggatatcgccactcgccagatgttgaataagccgccgttacccttcaccaaaggcttgcgtctgggcaatatgccgcagattcgtaccatcgtggacgaagagctggaaagcgtctggaccgggaagaaaaccccacaacaggcgttggataccgcggtggatcgcgggaatcagttactgcgtcgttttgagaaagcgagcaaatcttaagtgtataagtgcctgatggcgctgcgcttatcaggcctacagcgtttgtaggccggataaggtgcttgcaccgccatccggcaccttccaggaaaagaaccttcatgtcatcatcccgtccggtgttccgctcgcgctggctgccgtatttactggttgctccgcagttggttatcaccgttattttctttatctggcctgcgggcgaagcgctgtggtattcgctgcaaagcgtcgatccgtttggtttttccagccaatttgtcgggctggagaatttcgtcgcgctttttcacgacagttattatctcgacgccttctggacgacgattaaattcagcgcgctggtcacgtttagcggcctgctggtctcattgtttttcgccgccctggtggattacgtggtgcgcggcagccgtttttatcagacgctgatgctgctgccttatgccgtcgcgcccgccgtcgccgccgtattgtggattttcctgtttaacccggggcggggattaatcacccatttcctcggcgaattcggctatgactggaaccacgcgcaaaacagcggtcaggcgatgttcctggtggtatttgcgtcagtctggaagcagattagttacaactttttattcttctttgccgcgctgcaatctattccccgctcgctggtggaagcggcggccattgacggcgccgggccgattcgtcgtttcttccggctttctttgccgcttattgcgccggtcagtttcttcctgctggtggtcaacctggtgtatgcctttttcgacaccttcccggtgattgacgccgcgaccgccggcgggccggtacaagccaccacgacgctgatttataagatttattgcgaagggtttaccggcctggatctctcggcgtccgccgcgcagtcggtggtgttgatgttcctcgtcatcattctgacggtggtgcagttccgctatgtggaaagtaaggtgcgttaccaatgatagagaatcgtcgcgggctgacaatattcagccataccatgctgattctggggatcgcggtcattttgtttccgctgtatgtcgcgtttgtcgcggcgacgctggacgaccgcgcggtgtttgagacgccgatgacgctgcttcccggcacgcagttactggagaatatcaaaactatttgggtcaacggcgtcggtgttaatagcgcgccattctggctgatgatgcttaacagtttcattatggcgttcagcattacggtaggcaaaatcacggtatctatgctttccgcattcgccatcgtctggtttcgttttcccctgcgtaacctgttcttctggatgatttttatcaccctgatgttgccggttgaagtgcgtatcttcccgacggtggaagtgatcgccaacctgaaaatgctcaacagctatgccggtctgacgttaccgctgatggcgtccgctaccgccactttcctgtttcgtcaattcttcatgacgcttccggatgaactggtggaggcggcccgtattgacggcgcgtcgccgatgcgctttttccgcgacatcgtgttgccgctgtcaaaaaccaacctggcggcgttattcgtcatcacctttatctacggctggaaccagtatctgtggccgctgttgattatcaccgacgtgaatcttggcactgccgtagcgggtatcaaagggatgatcgccactggcgaaggtaccacgcaatggaaccaggtgatggcggcaatgctgctgactctgattcccccggtcgtaattgtgttagccatgcaacgggcgtttgtgcgtggtttagtggacagtgagaaataaaaatggctggtttaaaactacaggcagtaaccaaaagctggggcggcaaaacccaggtcattcaaccgctgacgctggacgtggcggatggcgaatttatcgtgatggtcgggccgtccggctgcggcaaatcaacgttgttgcggatggtggccggtctggaacgcgtgaccagcggcgatatctggattgatcgcaaacgggtcaccgagatggagcccaaagatcgcggcatcgcgatggtatttcagaactatgctctctatccccatatgagcgtagaggagaacatggcgtgggggctgaaaattcgcggtatgagcaaagcgcatattgaagaacgcgtgcgggaggcggcgcgcattctggagctggacggcctgcttaaacgccgtccacgcgagctttccggcggtcaacggcagcgcgtggcaatggggcgcgcgatcgtccgcgagccggcagtctttttattcgacgaaccgctctctaacctcgacgccaagctgcgcgtgcagatgcgtctggagttacaacatctgcatcgtcgccttcgtaccacctcgctctatgttactcacgatcaggtagaggcgatgacgctggcccagcgggtgatggtgatgaataaaggcgtcgcagaacagattggcacgccggtagaggtgtatgaaaaaccggccagtcgcttcgtggcgagctttattggcagcccggcgatgaatctgttggacggcgttatcagcgcttccggcgaccgtttcgaattgcctggcggtctggcgttgccgattggtgcgggctatcggggtcatgctggacgtaaaatgacgctgggtatccgcccggagcatattgcgttaagctcgcaggcggaaggcggcgtgccgttaacggtagacacgctggagattctgggcgcggataatctggcgcatgggcgctggggcgatcagaaactggtggtgcggttggcgcatcagcagcgcccggcggcgggcagtacgctatggctgcgtctgccggaacatcagcgacatctttttgatggcgaaacaggacaacgtgtatgagtaactggccttatcctcacattgtcgcccatcgcggcggcggtaaactggcgccggaaaacactctggcggcgattgacgtgggcgcgcgatacgggcacaccatgattgagtttgatgccaagctgtcgaaagacggcgaaattttcctgctgcatgacgataacctggagcgcaccagcaatggttggggtgtggcgggcgagttgaactggcaggatttattgcgtgtggacgctggcggttggtttagcggcgaatttaaaggcgagccgctgccgttgctctcgcaggtggcggagcgctgccgtaaacacggcatgatggcgaatattgagatcaaaccgacaacggggagcggaaggctaacaggacgtgtcgtggcgttggccgcccgcgaactgtgggccgggatgacgccgccgctgctttcttcctttgagatagaggcgctggaagcggcgcaggcggcagtacctgaactgccgcgcgagttactactggataaatggcgtgaagactggcgtgaactgacgacccgtctgggctgtgtttccctccatctcaaccataaattactcgatgagacgcgagtgcaagagattaaggccgcgggtctgcggattctggtgtataccgtcaatcagccccagcgggcggcagagctgctgcgctggggcgtggattgtatctgcaccgatcgcattgatgacatcggccctcactttcagttttaagggctgatagttttcagcgggatgtcaggctgcggcgtcccgctgtcctgctgcaacattggctgggaatggtttagcatccggtccggatttccgctgccgctgagcattccgccctgcgtattgggcagcgtttgctgaccgagcataccgttgcccggctgtccctgctgaacccgctgcgtattggcattcaactgcgactgtagattttgctgctggctgcgcgcctgcgtttgcatctgcgtctgcatacgctgctggctggggatttgataacctggctgattaggattattcatagtgttaattggctgggccaatacagcaaagggtaataaagccgtaataagtagtaagcgtttcattgtcgtctcctcccgatgaggcctctttttaagtgtacctctatttcgccatgatgatgattttttaagcgttgtggaccaggattaaacgggacatacacccctttatctggagaaaaacaacgatgaaaccaacgtttatgcgctgggtggcgatcgccgctctgctggccggggggacgtttagcgcggtggccaatcctcccgtcgcgccgccagtctcctatggtgttgaagaagatgtctttcatcctgtacgggcgacgcaagggatggtggcgtccgtggatgcaatggcgacgcaggttggcgtggatatcttaaagcagggcggtaatgccgtggatgccgccgtcgccgtgggctatgcgctggctgtcacgcatccgcaagccgggaatctgggcggcgggggatttatgctgctgcgcactaaagatggcgctaccacggcgatcgattttcgtgaaatggcgccggctgccgcgacccgtgatatgttcctcgacgatcagggtaacgccgatgcgaaaaagtcgctgacgtcgcatctggcatccggtacgccgggtaccgtggcgggtttctcgctggcgctggagaaatacggcacgatgccgctgaataaagtggtgcgtccggcgatgaagctggcggaagagggttttgtggttaacgatgcgctggccgacgacttaaaaacttacggcagcgaagtgatccccaaccatgagaacagcaaagccattttctggaaagacggcgagccgctgaaaaaaggcgataagctgatccagaagaatctggcgaaaagcctggaaatgattgccgaaaacggcccggctgcgttttataaaggggcgattgccgaccagattgccggggaaatgcagaagaacggcggtctgatgaccaaagagaatttagccagctataaagccgttgagcgtacgccaatcagcggtgactatcgcggatatcaggttttctccatgccgccgccgtcctcgggcggtattcacatcgtgcaaatcctcaatattcttgaaaatttcgacatgaagaagtacggctttggcagcgccgatgccatgcaaatcatggcggaagcggaaaaatacgcctacgctgaccgctcagagtatctgggcgatccggactttgtgaaagtgccgtggcaggcgctgaccaacaaagcctatgcgaaaacgttggccgatcaaatagatattaataaggcaaaaccttccagccagatcaaaccgggcaagctcgccccgtatgaaagcaaccagaccacccacttctcggtggtggataaagacggcaatgctgtgacggtgacctataccctgaacaccaccttcggcacaggaattgtggcgggaaataccggtattctgctgaataatcaaatggatgatttttctgctaagcctggtgtacccaatgtttatggcctagtgggcggcgatgctaacgcggtcgaaccaaaaaaacgtccgctgtcgtcgatgtcgccgactatcgtggtaaaagacggcaaaacctggctggtgaccggtagccctggcgggagtcgaatcatcactactgtgctgcaaatggtagtgaacagcattgattttggcatgaacgtcgccgaagcgaccaacgcgccgcgtttccatcatcaatggttgccggacgaactgcgggtagaaaagggcttcagccccgatacgctgaagttgctggaacagaaagggcagaaagtcgcgctgaaagaagcgatgggcagcacccaaagtattatggttggaccggatggcgaactgtacggtgcgtctgacccgcgttccgtggatgatttaacggcgggatactgatttttaattccaggcccggtgtcagacaccgggctatttgcagattatgccgtgagtaatcgggctggattatcaatacaaagcttgcgcagagtatcgttgtctactccgcgagcagccaaataggcgaggaaaacattcgggacaaacccccagccatttccgccatttttcgcccacatctgtttgagaaaaacatcatggcttaaaacgatttggtcggcgtaacccagtgcaatcagattcgctactgcatctgcggtctcctgaacgcccggcgcgacaccttcttttggaaaggtgatgtccagaccaatcatgtcaaattcaagccatacgccgcggtcgagcattttacgttgatagacgacatcttttcctgaagggtccgaatgcgccagcgagacttttgccggagagacgttcatttcttccagcacgatatccagcacctcatcacccagtcgcagccaccctggcatatggatattcatcgccgtgtgggggttgttacattgtgccagagacgctgcccgcaggctgttacgctccgcttgggtaaacgcgggagatacgccgatttcaccgatcatgccagcgcgaatatccgtctcgccaataccctgattcagttctttatcaatgagtgaggctaacagctcaacaggtttatggatccgggtgctttcaaatttctccagataaggcccggatgacgcaacgatattcaaacccgtttttaaggcaacttctcgtagcgctgaggcatcccgtccaatggattctgaaccggtggcgtcgacaatcgtcctgccgcccaaagacataaagttattgatttcgaagataacatcatcaatctcttttctgtccatgttatcggcgcagcagtatgggtcgtgtttcagcccccactgcaggtcagcactgactttctttcccaccagttgctgtgaaaaagcataatgtggctcgtctacgaccgaagacagatcgttaaacagatgttcatgcggtagcgtcagccccatatccgtatgcgccaccgggcctgttacggtttgcaggaaacctttcattctgacacctccattttttgcgccattttggatgctctgtattcagggatggtggtcacaatcgcaccgactaacgcgaacagcgtaccgatgatggtgaccaggtagaccgtattgcctaatgaagggatcaattcatcaattagcactgagccaagcagttggcctgctgttgacgctacgcccagcatcaatagccctaagcctctcaccagaatcgccattagcccgatggatagcagacccagcggaccaccgagatacatccaccatgtatcgagtaactggatggtgacatggcctaatgcgatacgtatcgccagcgccgcgcccaggacacaaaagccgacgatgaagttccatgtaatggacaccagcatggagcccgttgcctcggcgactttcgcattccccgcaggctgccagccagcgagtaaccctgccaaaaaggggaggatagcgagcaggataaacgaggttgagtgccactgtggcgacacgacaaaaatggtggcgataacggcgaacaatgcgccagtaatgcgccatggcgtaaaatattttttctcctccacgccgatgccaaaacggtcgcacagcaggccggaaagaagcagagcggaaattaatgccgtttgaaaggtggcaacgcccagcgcgctggcggatgcgccttcagaaaatacgaccatcgccccgcataatcctgcaaaccaattccatagcgggatttttctctttttaatcagagtagggattgaggcgaattgctggcgtgtttctttgcgcgcaataataataaaaaacatgacgaccagaccgctggcaaacgagattactgcgcaagcattaccgtcttgtaaccaatgtcctaactgcccattaacggcagactgcatcggggaaagcataccggctaagatggtggcaagcatcagtaagggggttgagtacttattcttgttcatacatcaatccttatattttataaaaggagtaactttcgttactccattgttttttattttctggcgatgaattgaagcgtgttgacccacaggtcggtataaaatggccatgacataaactgctgggttccccagtgtggggagcagtcactcataaagcaggcggttttaccctgttggtattcaccgaacactaacaatgggtcattatttattgttaatacgacatcggcatcgtctctggcgacgacctggttatatccaagaaataccgggtaatctgagaacccgttaacaacaggatgttcaggtgagacagcctcagcacaaataccctctggcttttctacccggtcatcgccgtcaagcataataactggcagaacctcagcaagaacggtgttcttataattggcttttgcctcaatacccataaatgacagataaccgccaatcatgagtagtccaccgccatttttgacgtactctttaatggattccagagcgtttggttttatttttagctgatagaaggtttcattttgtagcaggaaggtattactaccaatgtcgctaataacaatcacatcataacgatttaattcgtcaatactctctggaaaggcaatttgtaccgtgtgggcaggcatgtaatcaatatcaacgccgcctttcctcaggcattccagtaaccatgtcgcgccttcttcatatttactggaggtgaaactgtcataaccttttgaatgaatcatatgaatatgccaggattctccaataaagagcacctttagttttttctgcgtattgttcatagtctgctccttgatttagtgagtagagatagtttgtttgtaatgtgaaccctgaatacgatgaagaacggagtcgttttccggcatatcagaggcattaggcgtttcaaccgcaagtgaggcaaatgcgctggcgtagcacaatgcggatgccagtgactttccttttgcaaggccagatgagagggcgccattgaaagcgtcacccgctcccgccgtattttttacaactgccggaaatgccggggaatagatgaattgtgtgccgtcataagcaagcgaacctttgctacctaatgtaataatggtatttttgacgcctttctggtgaataattttggccgcgcatttggctgattcgatatcattaaccgccatattggccagcaggccggcttccgtttcatttggcgtaatatagtcaatgttatcaatgatggtgttaaccatgtcattgtacggcgctggattgatgatgaccggtatgtcatttttttgtgcgagacgaattgtttgctgcagcgcttcgtaattcgtctccagttggacaagaacaatatctgaatgaacaatggcttctttttgaatggtgatttcatcaggggaaattgtcatgttggcgccagggtagatagcgatgacattatctccggtatcaccattcaccatgatggttgctgtacctgtttgtgtttctttggtctggtagataacacttttatggatttttgatgagtttataaaattaatggcgtaatcgctaaaatgatctgagccgactttagtaataaaatgcacatcagaatcggcatagcttgctgctaatgcctgattacatcccttaccgccgggtgaaaaaataaatttatcggccagcaatgattctcccgttgagggtaatctcggtagataactgataatatcaacattgaacgagccaataacacatacattatttttcatggcagagagacctttttttattttctgcgctgattcatatttttccagcacataagcaatttcattttttgcgacgttatcaagagaatcaagggtaataaatgcaccaccatgacagcgagtaagatatccctgtccggcaagttcattgagatctgaacgaatagtttcctttgttaccttgagacttttcgccagatttgaaacttttacaactcccgaaatactgagttccttcaatattctatgatggcgttcaaatttcattttttacctcaccgtggttaaattagtcccgggaggagtatattgttgtgattgtcaccataaagtgatggcagaaaccaaaaaaaaacaaaaatgtaatattaatattgctaaaattacggaaaaaacggtgataaagcttaaagtggtaataaccatgaaattcaagtggttattgttttgatataggggaagtaggctgcaataactggaatgttgtgaaggtttgtgacgtttcgccccacagggtggggcggggaagcgctatttcacgcgcgccataaagtacgtatcaacgtactcaccgttgcgcaggccgtatttcttaccggtgccttcgatttcaaagccgtacttcttatacaccgccaccgcgggctcgttatcaacaaacaccgttaactcaatacgctcgacgcgcagccagttgtcacacatgtcgatcatcgtgcggatcagcgcgctggcaatgccgcgattgtgccaccgggcatccacgcagataccaaaatcggccacgtggctgcgacggggacgttgggtgacctgaatagaaagatggccaacgacaatatcgtcaatgcaggcaaccagttgtttaaccccggcttgctcggttagccgcgcctgccacatttcgagggaaggatgaggaacctgtagcgtgttgtggtacacctccggctgggcgtggatctgacgaatggcgtcgtaatctttcggttcagcgtggcgtatcactatttcactcattccttatctcctgcagggttaattgtgtatttacactcgctgagaaagaaaattccgtcaaccgcatttttttgcaaaaagaagtagacaagtgcgaatgagaatgattattattgccttgcattcaggggaacccctacggataacctgaaagcatgacattgctcacattgcttccagttttattttggccagcttttgctggctttttttttggttttgtttcagcctggcttacttgtcattttgtccccgggaagtgctcgtgctcctcacgtacatttagtacgctccgggccctgcgcgcttgccgtgaacaaactgaccgcgacgctgacggccgatcttgaggcatctgcttttgtaggcccgaaaaggcttctccgccaccgtcaaagaatccaacattcagtctcctcacgctttgcgctatggtgtaaacaatcatcttcaaaaggatcgtctcatgaccttacactgcgcatttattggattcggcaaaagtaccacccgttaccatctcccctacgttctgaatcgtaaagatacctggcatgtcgcgcatattttccgtcgtcacgctaaaccggaagagcaggcgccgcagtattcgcatattcacttcaccagcgatctggatgaggtgttgggcgatccgcaggtaaaactggtgatcgtctgtacgcatgctgacagccatttcgaatacgccaaacgcgcgctggaagcgggtaaaaatgtgctggttgagaaacctttcacgccgacgctggcggaggcaaaagtgttgttcgaactggcgcgaagcaaaggactgaccgtcacgccatatcagaatcggcgttttgattcctgttttctcactgctaaaaaagcgattgagagcgggaaactgggcaagattgtcgaaattgaaagccatttcgattattaccgcccggtagcagaaaccaaaccgggcctgccgcaggatggcgcattctatggacttggcgtccacactatggatcaaattatttcgctatttggccgcccggatcatgtcgcgtatgacattcgtagcctgcgtaataaagcgaatccggatgacacctttgaagcgcaattgttctacggtgccctgaaagccattgtgaaaaccagccatctggtgaaaatcgactatccgaagtttattgttcacggcaccaaaggttcgtttgtgaaatacggtatcgatcaacaagaaaccagcctgaaagcgaacattatgcctggcgagccgggttttgccgctgacgaatccgtcggtgtgctggaatatgttaacgatgaaggcgttacggtgaaagaagaggtgaaaccggaaacgggtgactatggtcgcgtctatgatgcgctgtaccagacgttgaccatcggtacgtctaattatgtcaaggaatctgaagttcttaccaatctggaaatcctcgaacgtgccttcgaacaggcaacgcctgcgacgataaccctcgctaaatagcccttacagactcctctgcgcttattcatattttttgaacagaggagtcaattttcaccctctatgatcccggacggaatgagtccacacttattccatcgaaaacatctgggggtgaacacaatgatctacttacgcaaagcaaacgaccgcggtcatgcgaatcatggctggcttgactcctggcataccttttcttttgccgattattacgatccgaactttatggggttctcggcgctacgtgtgattaacgacgatgtgatcgacgcaggccagggtttcggcacgcatccgcataaagacatggaaattttgacctatgtgctggaaggtgctgtagaacaccaggacagtatgggcaataaagaacaggttccggcaggtgaattccagattatgagcgccgggaccggcgttcgccactccgagtacaacccgagcaaaacggatcgtctgcggctgtaccagatctggatcattccgcaagaaacaggcatcacgccgcgctacgaacagcgccgcttcgacgccgcgcagggcaagcaactggtgctttcgccagatgctcgcgatggttcgctgaaggtccaccaggatatggagctgtaccgctgggcgctgctcaaagatgagcaatcggtgcatcagattgccgccgagcgccgcgtctggatacaggtggtaaaaggtaacgtgaccattaacggtaccaaagcgacgaccagcgacggcctggcgatttgggatgagcaggcaatctcgattcatgccgacagcgacagtgaagtgttactgtttgacctgccgccagtctaaaaatacacgtcatccttcaagctgcatctgtgttggctttattactcggcccatccataggcctcgccccttcggggccgctgcgagcagcgttcaaatctgctcccggcagatttgtcgctcaccccggtcgcgtacttaatgtacgctcccggggatttactgagggacatccttgtccctcaccagaggcaaccttcggttgttcaaattcgttcctgacgaatttgtcactgcgtcgccgccttgatgcaactcgaatgattttgtgtatttctcataataaaaactcctttttctctgcgaaggttcacgcacgtccgtggtaaactggggaaatctatccctttttaacgcttcaggacgatgaaaaagaaaagacccgtacttcaggatgtagccgaccgcgtgggcgtgaccaaaatgacggtcagccgctttttgcgtaacccggagcaggtctccgtggcgctgcggggcaaaattgccgctgcacttgatgagctgggttatattcccaatcgcgctcctgatatcctttctaacgccaccagtcgcgctatcggcgtgctgttaccgtctctcaccaatcaggtctttgcggaagtgttacgcggcattgaggccgtcaccgatgcccacgggtatcagaccatgctggcgcactacggctataaaccggagatggagcaggagcgcctggaatcgatgctctcctggaatatcgacggtcttatcctcacagaacgtacccatacgccgcgcaccttaaaaatgatcgaagtcgccgggattccggtggtggaactgatggacagccagtcgccgtgtctcgatattgccgttggttttgacaacttcgaggccgcccgtcagatgaccgccgcgattatcgcgcgtggtcatcgtcatatcgcctatctgggggcgcgcctcgacgaacgtactatcatcaagcagaagggctatgaacaggcgatgcgggacgccggcctggttccttacagtgtgatgatggagcaatcttcatcctactcttccggtatcgaactcatgcgccaggcgcgacgcgaatacccacagcttgacggtattttttgcaccaacgatgacctggcggtgggggcggccttcgaatgccagcgcctggggctaaaaatcccggacgacatggcgatcgccgggttccacggtcatgacatcggccaggtgatggaaccgcgtctggcaagcgtcctgacgccgcgcgagcgaatgggcagcattggcgcggaacgtctgttggcccgcattcgcggcgaaacggtcacgccgaaaatgttagatttaggtttcaccttgtcaccgggcggatctatttagtctgacaactttgaagtagctcacacttattcacttttggcacgaatggtcattgcgtcgtgaatggtgcggttggacaatgttaccgataacagttacccgtaacaaattttgcaacttgtagagtggggtcccgctttgagcacgactaatcatgatcaccacgtttacgttctgatgggcgtatcaggcagcggtaaatccgctgtcgcaagcgccgtggcgcatcagcttcatgccgcgtttctggacggcgattttctgcatccgcgctgcaatattgaaaaaatggcttccggcgagccgttgaatgatgatgaccgcaaaccgtggttgcaggcgctgaacgacgccgctttcgcgatgcagcgtaccaataaaatctcgctgattgtctgttccgcactgaaaaaacactatcgcgacctgctgcgcgagggaaacccgaatctctcctttatctatctgaaaggtgatttcgacgtcattgaaagccgtctgaaagcgcgcaaaggtcatttcttcaaaacccagatgctggtgacgcagtttgaaacgctgcaagaaccgggtgccgacgaacgcgatgttctggtggtggatatcgaccagccgctggaaggcgttgtggcgagcaccattgaggtcatcaataaaggcagtacgctgtgagtacattaacactggttttaaccgccgtcggttccgtcttactgctgctgtttctcgtgatgaaggcgcgtatgcacgccttcgtcgcgttaatggtcgtctcaatgggcgcggggcttttttcagggatgccgcttgataaaatcgccgcgaccatggaaaaagggatgggcggcacgctgggcttcctggcgattgtggtcgcgctgggggcgatgttcggtaaaattctgcatgaaaccggcgcggtcgatcagatagccgtgaaaatgcttaaatcctttggccataaccgcgcgcactatgcgattggccttgccgggctgatttgcgcgctcccgctattctttgaagtggcgattgtgctgctgataagtgtggcgttctttatggcgcgtcataccggcacaaacctggtgaagctggtcattccgctgtttgcgggcgtggcggcagccgcggcgtttttgttgcctgggcctgcgccgatgctgctggcttcccagatgcatgctgatttcggctggatgatcctgattgggctgtgcgccgccattcctggcatgattatcgccgggccgctgtgggggaattttatcagccgttacgttgagctgcgtattcctgacgacattaccgagccgcatctgggcgaaggcaaaatgccttctttcggcttcagcctgtcgctgatcctgctgccgttggtgctggtaggactgaaaacgatcgccgcgcgctttgtgccggaaggttccaccgcttatgaatggtttgagtttatcggccaccccttcactgcgattctggtcgcttgtctggtagcgatttacggcctggcgatgcgccaggggatgccgaaagacaaagtgatggaaatctgcggccacgcgctacaaccggcgggcattattctgctggtgattggcgcaggcggggtgttcaaacaggtactggttgactccggcgtcggcccggcgctgggcgaagcgttaaccggtatgggactgccgattgccattacctgctttgtgctggcggcggcggtgcgcatcattcagggttccgcgaccgtggcgtgtttaaccgcggtcggtctggtgatgccggtcattgagcaactgaatttctccggcgcgcagatggcggcgctctctatctgtatcgccggcggttcaattgtggtttctcatgttaacgacgctggcttctggctgttcggtaaatttaccggcgcgaccgaagcgcagacgctgaagacctggacgatgatggaaactatcctcggcacggtcggcgcgattgtcgggatgattgctttccaactgctgagctgagtcttgttgcccggtggcgctgtgcttaccgggcctggaaacgggcacatatcgataccgtaagccgggtaaggcgtaatcgctacccggtttttttattgaggtgtgcatggcaatcgcccaatgacattttgcctcgccatgtttcagtacgcgcataaaagcaggcaaatttctacgctgatccataattaggatcaataaaacagcgacggaaatgattcccttcctaacgcaaattccctgataatcgccactggactttctgcttgcgcggtaaggcaggataagtcgcattactgatggcttcgctatcattgattaatttcacttgcgactttggctgctttttgtatggtgaaggatgcgccacaggatactggcgcgcatacacagcacatctctttgcaggaaaaaacgctatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgacgcggcttctacgctgcgcatgaaagatgatgccattattattctcgacccggtcaaccaggacgtgattaccgacggactgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccaaatggggcagttgtatggccatgtcgccgatgaactggcgacgccgtcttccgcaattcttgatattgaacgcaaagttacggcattgacccgcagcggcgagctgccggtggataactttggcgtaccgctggcgggaagcctgatcccctggatcgacaaacagcttgataacggccaaagccgcgaagagtggaaaggccaggcggaaaccaacaagatcctcaatactgcctctgtgatcccggttgatggtttgtgcgtgcgcgtcggcgcgctgcgctgtcacagccaggcgttcaccattaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtagtggctattgcagcgcttatcgggcctgcgtgtggttctgtaggccggataaggcgtgtcagcgccgccatccggcaatatccgccagataaggcgtagtcggcaagcagacgtcagattgatatgtagggtgcatcgtcacctttttttgcgtaatacaggagtaaacgcagatgtttcatttttatcaggagttaagcagagcattggctattctttaagggtagcttaatcccacgggtattaagcctaacctgaaggtaggacgacgcagataggatgcacagtgtgctgcgccgttcaggtcaaagaagtgtcactacctgatgttgaattcagtgagatggagtgacgccacaaaacaggataacaaaccatgtccagtcgtatcgatagagacgtgattaatgcgctaattgcaggacattttgcggaccctttttccgtactcggaatgcaccagacccaagccggactagaagtccgcgccctattacctgacgccaccgacgtatgggtgattgaacccaaaaccggacgtaaagtcggcaaactggaatgtctcgacgctcgcggttttttctgcggcgttttaccccgacgtaaaaatttctttcgctatcagctcgccgtgacctggcacggacagcagaacctcatcgacgatccttaccgttttggtccattaatacaggaaatggatgcctggctattgtcggaaggcacccacctgcgtccttatgaaacgctgggcgcgcacgccgatacgatggatggcgtcaccggcacccgtttctccgtctgggcgcctaatgcccgtcgcgtttcggttgtcgggcaattcaactattgggatgggcgtcgccacccgatgcgtctgcgcaaagagagcggtatttgggagctgtttatccccggcgcgcataatggacaactgtataaattcgagctgcttgatgcgaacggtaatctgcgcattaaagccgatccctatgcttttgaggcgcagatgcgtccggaaacggcgtcgatgatttgcggactgccggagaaagtgacgccaagcgaagaacgacaaaaagccaatcagtttgatgcgccgatctcgatttatgaggtgcatttaggttcatggcgccgccatacggataacaatttctggctgagctatcgtgagctggcggatcagcttgtgccttacgccaaatggatgggctttacgcaccttgaactcttgccggttaacgaacatccgtttgacggcagttggggctaccagccgaccggcctctacgcgccgacccgccgctttggtacgcgggacgacttccgctatttcatcaatgcggcccatgcggcgggccttaacgtcattctcgactgggtgccgggccatttcccgtccgatgaatttagcctcgcggagtttgacggcacccacctctatgagcatagcgacccgcgcgagggctatcaccaggactggaatacgctgatctacaactatggtcgtcgtgaagtcagtaattatctggtgggtaacgccctgtactggatggagcgttttgggattgatgcgctgcgtgtcgatgcggtggcctctatgatctaccgcgactacagccgcaaagagggcgagtggataccgaacgagttcggcggtcgtgaaaacctggaagccattgagtttctgcgtaataccaaccgcattattggcgagcaggtgcccggcgcggtcagcatggcggaagagtcgacagacttctctggcgtgacgcgtccaccggaaacgggtgggctggggttctggtacaagtggaatctgggctggatgcacgacacgctggactacatgaagctggacccggtgtaccgccagtatcatcacgacaagctgacctttggtatgttgtacaaccataccgaaaactttgttctgccgctgtcgcacgatgaggtggttcacggcaagaaatccattctcgatcgtatgccgggcgatgcgtggcaaaaattcgccaacctgcgcgcctattatggctggatgtgggccttccccggcaagaaactgctgtttatggggaatgagtttgcccagggacgcgagtggaaccatgacgccagcctcgactggcacctgctggaggggggcgataactggcaccacggggttcagcgtctggtgcgcgatctcaaccacacctatcgccaccataaagcgttgcatgagctggatttcgatgcttacggctttgagtggctggtggtcgatgacaatgaacgctcagtactgatttttgtacgccgtgataaagccggtaacgagatcatcgtcgccagcaactttacgcccgttcctcgccacgactaccgctttggcatcaaccagccgggacgctggcgtgaaattctcaatactgattcgatgcattatcacggtagcaacaccggcaatggcggtgtggtgcacagcgatgagatcgaaagccatggccgtcagcactctcttaacctgacgttaccgccgttggcgacgatctggctgatgcgggagggggaatgacgcagcttgcgatcggcgaagcaacgccgcatggcgcaacgtatgacggtcatggcgtgaatttcacgctcttttccgcccatgcggagcgcgtagagctgtgcgtttttgattcccgagggaatgagcgtcgctatgacctgccaggacgtcgcggcgatgtctggcatggttatctggcaggcgccaggccaggtttgcgctatggctatcgcgtacatggcccgtggcagccagcgcaggggcatcggtttaatccggcgaagttactgcttgacccttatgcgcgccaagtcgagggcgaactaaaagatcatccgctgttgcacggcggacacgatgaaccggactaccgcgataacgcggcggtggcgccgaaaagcgtggtaatcagcgaccattatgactgggaagatgacgccgcgccgcgcacgccgtggggaaaaacggtcatctatgaagcgcatgtcaaagggcttacctatctgcatccggaactcccccaggagatacgcggcacctataaagcgctcggtcatccggtcatggtggcgtacttcaaacagcttggcattacggcgctggaactgttgccggtggcgcagtttgccagcgagccgcgtctgcaacgtatggggctgaccaattattggggttataacccaatggcgatgtttgcgctgcatcccgcctgggccagttcgcccgagacggcgctggacgagtttcgcgatgcggtgaaagcgctgcatcgcgcggggattgaggtcattctggacatcgtattaaaccatagcgccgagctggatctggacggtccaaccttctccctgcgcggaattgataaccgtagctattattggataagggacgatggcgattatcacaactggacggggtgcggcaacacgctcaatttaagccatcccggcgtggtggaatacgcgtgcgagtgtttgcgctattggatggaaacctgtcatgtcgatggttttcgttttgatttggcgtccgtcatggggcgcacgccgacgtttcgccaggatgcgccgctgttcgccgcgattaaagcgtgtcctgtgttatcaacggtcaagctgattgctgaaccgtgggatattggcgagggcggctatcaggtcgggaattttccgccaccgtttgccgagtggaacgatcattttcgcgatgcggcccgccgattctggttgccgcgtaacctgacgaccggggagtttgcctgtcgtttcgccgcttccagcgatgtgtttaaacgcaatggccgcgcgcccggcgcctctgtcaatctgctcacggcgcatgacggttttacgctccgggactgcgtctgtttcaatcagaaacacaatgaggcgaacggtgaggaaaatcgcgacggcatcaacagcaattacagcgacaatcatggtaaagaaggattaggcggtccgcttgatttaatggagcggcggcgcgacagcattcatgccctgctggcgacgctactgctctctcagggaacgccgatgctgctggcaggcgatgaacacggccatagccagcacggcaacaataacgcctactgtcaggataatgccttaacctggctggactggcagcaggcaaatcgtgggttaaccacgtttaccgccgcgctgattcgtttgcgtcagcagataccggctttaaccggcaatagctggtgggaagaaggcgatggcaacgtgcgttggctaaataaaaacgcgcaacccttgagtgcggatgagtggcaaaacggacctaagctgatgcaaattctgttgtcggaccgttttctgattgcgataaatgccacgcttgaggtgacagatatagttttacccgaaggggaatggcgcgccgttcccccattcgctggagaggataatccggtgataacggcggtctggcagggactgtgtgtgttccagagaggataaaaaaggagttaatcatggtgagtttagagaagaacgatcgtgtaatgttggcgcgccagctgccattgaaatctgttgccctaatcctggccggcggccgcggcacgcgtctaaaagatttaacgaacaaacgcgccaaaccagccgtccactttggtgggaagttccgcatcatcgatttcgccttatctaattgtctgaactccgggattcgccgtatcggcgtgatcactcagtatcagtcccacacgctggtgcagcatattcagcgcggctggtcattgtttagcgaagagatgaacgaatttgtcgatctgctgccagcccaacagcgtatgaagggcgaaaactggtatcgcggcacggcagacgcggtgacccagaacctggatattattcgttgctataaagcggaatatgtcgtcatcctggcaggcgatcatatctacaagcaggactactcgcgtatgttgatcgatcacgttgaaaagggcgcgcgttgcacggtggcctgtatgccggtgccgatcaaagaagcgacggcgttcggcgtgatggcggtcgatgaaaacgacaagattattgattttgtcgaaaaaccggcgaatccccccgcaatgcctggtgacgccagcaaatcgctggccagtatgggcatttacgtttttgacgccgattacctgtatgaattgttggcggcagacgataaagatgacgcttccagccacgatttcggtaaagacattatccccaaaatcacccgcgaaggtatggcttacgcgcatcctttcccgctctcctgcgtgcagtccgatccacaagccgaaccgtactggcgtgatgtaggtacgctggaagcttactggaaggcgaacctggatttagcctcggtgacgccggagctggatatgtatgaccagaactggcctatccgtacgcatatggaatcgctaccgcctgcgaaattcgtgcaggaccgctccggtagccacggtatgacgctgaactcgctggtctccggcggctgcattatctctggttcggtggtggtgcaatctgtgctcttcccacgggtgagaataaattctttttgtaatattgattcggcagtgttgttacctgaggtttgggtagggcgctcttgccgtttacgtcgctgtgttattgaccgtgcctgtattatcccggaaggcatggtgattggtgaaaatgcggaagaggacgctcgtcgtttctaccgttcagaagaaggtattgtactggtcacgcgtgaaatgctgcgcaaactgcaggtcaaacaggagcgataatgcaggttttacatgtatgttcagagatgttccccctgctgaagactggggggctggcggatgtgataggcgcgttgcctgcggcacaaattgcggatggtgttgatgttcgcgttctgcttcctgggtttcccgatatccgtcgggggatacccgatgcgcatgtggtgagccgccgcgatactttcgcaggtaagatatcgctgctgttcgggcattataacggcgtgggcatttatctgatcgacgcgccgcatctgtacgagcgtccaggcagtccctatcacgatacgaatttatatgcctatatcgataacgtgctgcgctttgccctgttagggtgggtcggctgtgaaatggcctgcggacttgatccattctggcgccccgacgtggtgcacgcccatgactggcacgccgggctggcgcccgcctatctggcggcgcgcgggcggccggcgaaatcggtctttaccgtacacaacctggcctatcaaggcatgttttatgcaaagcatatggatgacatcgagctgccgtggtcattctttaatatgcatgggctggagttcaacggacaactctcctttttgaaggccggtttgtactatgccgaccatattacggcggtgagcccgacctatgcgcgtgaaattaccgaaccgcagtttgcttatggtatggaaggcctgttgcgtcagcgtcatctggaagggcgcttgtccggcatactgaacggcgtggatgagaagatctggaacccggaatccgatctgctgctggcgtcgcgctacacgcgcgataccctggaagagaaggcggaaaacaaacgtcagctacaaattgcgatggggttgaaggttaacgacaaagtgccgctgttcgccgtggtaagccgtctgaccaaccagaaaggtctggatctggtgctggaggcgttaccggggctgctggagcagggcggccagttggcgctacttggcgcgggcgatccggtgcttcaggaggggttcctcgcggcggcggcggaacacccagggcaggctggcgtacagatcggctatcacgaagctttctcgcatcgcattatgggcggcgcggacgttattctggtgcccagtcgtttcgaaccgtgcggcttaacgcagttatatggcttaaagtatggcacgctgcctctggtgcggcgtaccggggggttggccgatacggtctccgacagttcgctggaaaatctggcggacggtatcgccagcggttttgtctttgaagacagtaatgcctggtcgttgctacgcgcgattcggcgtgcttttgtgttgtggtcacggccttcgctttggcggtttgtacaacggcaggcgatggcgatggattttagctggcaagttgccgcgaaatcataccgcgagctgtactatcgcttgaaatagtcatccaggaatcatttatatgaatgctccgtttacttatgcatcgcccacactcagcgttgaggcgcttaagcattctattgcctataagctgatgtttacgattggtaaagacccggtcattgccaataaacacgaatggctgaacgccacgttgttcgcggtgcgcgatcgtctggtggagcgctggctgcgttctaatcgagcccaattatcgcaggaaacccggcaggtttattacctgtcgatggagtttttgattggtcgtactctttctaacgcgctgctctcgctgggcatttatgacgacgttaaaggcgcgctggaggccatgggcttagatctcgaagagctgatcgatgaagagaatgacccagggcttggcaacggcggcttaggacggctggcggcttgcttcctggactcgctggcgacgctaggattaccgggtcgcgggtatggcattcgctacgactacggcatgtttaagcagaatattgtcgacgggcggcaaaaagaatctccggattactggctggaatatggcaacccgtgggagttcaagcgccacaatacgcgctataaggtgctttttggcgggcgcattcagcaggaaggtaaaaaagcgcgctggattgagacggaagagattctggccgtcgcgtatgatcagatcatccccggttacgacaccgacgccactaacacactgcggctgtggaatgcgcaggccagtagtgaaatcaacctcggtaaattcaaccagggcgactactttgcggcggtggaagataaaaaccactctgagaacgtttcacgggtgctctacccggacgattccacctattccggacgcgagctacgcctgcgccaggagtattttctggtctcggcgacggtacaggatatcttgcaccgtcattatcaactgcataaaacctatgagaatctggcggataaaatcgccattcacctcaatgatacgcatccggtgctgtcaattccggagctgatgcgcctgctgattgatgaacataaatttagctgggacgacgcgtttgaggtgtgctgtcaggtcttctcttataccaaccatacgttgatgagcgaggcgctggaaacctggcccgtcgatatgctggggaaaattctgccccgtcacctgcagattatcttcgagattaacgactatttcctgaaaacgttgcaggagcaatatcccaacgataccagcctgcttggacgcgcgtcgattattgatgagtcgaacggtcgccgggtacggatggcctggctggcggtggtagtcagccataaagtcaacggcgtttctgaactccattccaacctgatggtgcagtcgctgttcgcggattttgcgaagattttcccgacccgtttttgtaacgtcacgaacggcgttacgccgcgccgctggctggcgctggcaaacccgccgctttctgacgtgctggatgagaatattggtcgtacctggcgtaccgatcttagtcagctcagcgagctgaagcagcattgtgattatccgctggtcaatcatgcggtgcgtcaggcgaagctggaaaataaaaagcggctggcggtagtgatagcgcaacaactgaatgtggtggtgaaccctaaagcgttattcgacgtgcagattaagcgtattcacgaatacaagcggcagttgatgaacgtactgcatgtcattacccgctataaccgcattaaagaaaatccggaggccgactgggtgccgcgggtgaatatttttgccggtaaggcggcttccgcctattacatggcaaaacatatcattcatctgatcaacgacgtggcgaaagtgattaacaacgatccgcagattggcgacaagctgaaagtagtgtttatcccgaactacagtgtcagtctggcgcaggtgatcattcccgctgccgacctgtctgagcagatttcgctggcagggacagaagcttccggcaccagtaatatgaaatttgccctgaacggcgcgctcaccattggtacgctggatggcgcgaacgtagagatgcaggagcatgtcggcgaggagaatatctttatcttcggtaatactgcagaagaggtggaagcgttgcgcagacagggttataagcctcgcgactattatgaaaaagatgaagagctacatcaggtactgacgcagattggtaacggcgtctttaatccggaagagccaggccgttaccgcgatctggtagattcgctgattaactttggcgatcactatcaggtgctggcggactaccgcagctacgtggactgccaggataaggtggatgagttgtatcgtcgcccggaagagtggacgacgaaagcgatgctcaacattgccaatatgggctacttctcatcggacagaaccatcaaagagtatgccgaaaatatctggcatattgatccggtgcggttgtaaatcccgatgccgacggcgcttcgcttgcccggcctacgtttatgtatccttgtaggccggatcaggcgttagccgccatccggcatttttctcaggacgccagtgaaagttggtgtttctcaacatacgccgccagccactgggtgatgcgggactgctgctcggcggtcagccacatgccttctttggtgcgacgccagatagcgtcttcagtacggcgcacccattcgtgatccaccaagtatttgagttccgcttcgtaaaactcatgaccgaaatcttcgcctaaatcaagcagtgacgtggcttcgccgagaatccactccgtgttgctgccgtaagtgcgcgaatagtggcgcgccagcgattccgtcaggaacggataacgacgacgcagcttcgccgcgtaatcttcgcggctgccgtcgatgtcgtcgccgggcagtacgcacgttttggtccatgccggcccgatgcctggataataagacgccagtttttccatcgcatgttcggccagcttacggtaggtcgtgagcttaccgccaaacacggaaagcagcggcgctttgccgttttcatcatggatatcaagggtataatcgcgagtgatcgcctgcggcgagtcggactcatcatcgcacagcggacggacaccggagtacgtccagacgatgtcatcgcgccccagttgtttctggaagtgcgcgttatagaccttcaacaggtaattaatttcgctctcttcaatttttaccgctttcggatcgcctttatattcgacatcggttgtgccaatgatcgaaaactcttccatccacggaatgacaaagacgatacgcttatctttgttttgcagaatatacgcctgtttctgattatggacgcgcggcacgacgatatggctgcctttgatcaggcggatgccatacggcgacggcaggtgcatcccttcgtcgaagaactgtttgacccacgggccggtggcgttaaccagtccgcgcgcctgccagacatattttttaccggtgtcgatatcttccgcttcgacaatccacaggccattttcccgacgagcggcggttgcgcgagtacgggtaaggacttcgccgcctttacgcaccaccatctgtgcgttggccagtaccagacgcgcatcgtctacccagcagtcggagtattcgaatccgcgcacgatttcaggtttgagtaccgaatctgcgccaaaccgcacaccggtggaaccgggtaaactggtacgtttgccgaggtgatcgtacataaacagaccgatacggatcatccaggctggacgtaagtgcgggcggtgcggcagacgaaaacgcatcgggaaggcgatgtgcggcgccattttcaacagcacttcacgttcggccagcgcttcgctgaccagacggaactcgtagtgttcaaggtagcgtaagccgccgtggataagtttcgaactggcggaagaggttgcgcaggccaaatcctgcgcttccagcatgagtacggacaaaccgcgtccggcggcatcagccgcgatgcctgcaccgttaatgcccccgcctatcacgatcagatctttggtttccatgctgccctcttgcactttcgttaaagttcaaaaatgttcgttatcgaacataatagcaaagaaacgcgctattggtaacatcgaaaaaacattttagagtgatatgtataacattatggcgttaagctactccgtcaacgtacactgggcgataaaatgccttaattggcttcaccggcaataatgaaagagcgattcatggaacaatttgaatgtatcactgtagaagaggcgtatcagaaactgcaccagggcgcggcggtgctggtcgatattcgcgatccgcaaagttatgccatgggtcatgcgccgcaggcgtttcacttgactaacgatacgctgggcgcgtttatgcgtgagcatggtttcgataccgccgtgatggtaatgtgctatcacggcaacagtagtaaaggcgccgcgcagtatctgctccagcaaggctatgatgcggtttacagcattgacggcgggtttgaggcctggcatcgccgtttccctgccgatgtcgcgaatggcgcgtaatcccataaagatgcagcctccgacgagaagggtatatatactgtcttcttttgtatggactaagcgacagcaataatgttgatgattacttcctttgcgaatcctcgcgtggcgcaggcatttgttgattacatggccacccagggcgtcattcttactattcagcaacataatcaaagcgatatctggctggcggatgaatcgcaggccgaacgtgtgcgggtcgagctggcgcggtttatagaaaatcccggcgatccgcgttatctggcggctagctggcagtccgggcagactaacagcgggctacgctaccgccgttttccctttctcgccacgctgcgtgaacgagccggccctgttacctggatcgtgatgctcgcctgcgtggtggtctatatcgcgatgagtctcatcggcgatcagacggtgatggtgtggctggcgtggccgttcgatccggttttaaaatttgaagtctggcgctacttcacccatatctttatgcacttctcactgatgcatattctttttaacctgctgtggtggtggtatctcggcggggcggtagagaagcgcctgggcagcggtaaattaatcgtcattacggtgataagcgcgctgctaagcggctatgtacagcagaaatttagcggcccgtggtttggcgggctgtccggcgtcgtctatgcgctgatggggtacgtgtggctgtgcggagagcgcgatccgcaaagcggaatttacctccagcgcggcttaattatttttgcattattgtggatagttgctggttggtttgactggtttggcatgtctatggcgaacggcgcgcacatcgccgggcttatcgtcggtttagcgatggcctttgttgatacgctgaatgcgcgaaaacgaacgtgaggcgtatccggcctgtggtcgagatatttttccaggccgggtagggcgatgccgctatccggcgcaaggttggttactttcagagattattcatgaaacaaacacaacggcatgacgcgatcattgaactggtgaaaaaacaggggtacgtcagtacggaagagctggtggagcatttttctgtcagcccgcaaaccattcgtcgggatcttaacgatctggcggaacagaatatgattttgcgccaccacggcggcgcggcgttgccctccagctcggtgaacacgccgtggcacgatcgtaaggcgacgcaaacggaagaaaaagagcgcatcgctcgcaaagtcgcggcccagatccccaatggttcaacgctgtttattgatatcggcacgacgccggaagccgtagcgcacaccctgttagggcacagtaatttgcggatcgtgaccaacaatttgaacgtagcgaacacgctaatggcgaaagaggattttcgtattatcctcgccggcggcgaactccgtagccgcgacggcggcattattggcgaagcgacgcaggactttatcgcccagttccgtctcgatttcggcattctcggtattagcggtattgatagcgacggctcattgctggaatttgactaccatgaggtacgcaccaagcgcgcgattatcgaaaattcgcgccacgtgatgctggtggtggatcactctaaatttggccgtaacgcgatggtaaacatgggcagcattagtatggtcgatgcggtctacaccgataccctaccaccgccgggcgtgatgcaggtgattgccgaccaccatattcaattagagctgtgctaaaaagactgtcttatcaggcctacactctgcgcgcgatggtaggcctgataagcgaagcgccatcaggcacacgttaaaccccataccccatcatcttcagcaactgctgcgcgtgctgtaccgcgtcctgacggtgcgcgacgccgagtttctggtagaggttgcggatatgcgtcttaatggtggtcgcggccaccgccagttcgccggcaatctgttcgttgctgtaaccggaatagataagtcctaacacctgccattcacgctgggtgagcgggctggtgcgaataagctccgggacatccggatggttaagcagacgctcgacgaagccttcgtcaaaatgggcgaatttatgccggtgatgttggttaatatatcgcaggatgcgctgcgcgcgatgctgctccatctccggcagcgtattgagctggataagctgacgcaattgttgcgccatggcttctccttcaatcacaaaatggctgataaatccggtgcggttggcgagctgtaaggcatcaagcaatacgcgctgggcgtcgtttttccgcccggattgccagtaaagctgattgagtaacagcagattgcggtttaaatcgctcattaagcgcaggctacgggcattctcatttaactcttccagcacgatttccgcaggctcgaattcgcccagcaggatctgcgcgcgggcgatattgcgccactggccttgcagaaaatggttattggcaaacgccggttttggcgtatggcgtaaccagttggcggcggatttcttgtcgccggttaactgccagtaaatgacacgcaccttatcggcgttagagatccagtcgcagtgataacgaccattgcctaataatttttccagtcggttaagctgactacgggcattatccagatcgccgcgcgccagcgagcactgcaccagtaacgtcaggcactgcaactgttgttgcggctggaaggtggacagcacagcgataccgctgcgcgccgaggcttccgcttcgtcaaggcgcgcccacgcccacagcaattgcgcgcggatacgtaccagaaactcatgcatcggcagttgttccagatgttgctctttgatcaactggaaggctctctcctgcgtttcccatgcggcctgcaggaatccctgggcgaactgaatttcgctttgttgaattaagctccacagcgcgtaatgccagacgtcatgatggcgcgccatttgttcggtttgctgcatcagcgataaagactggctgagattgcctttacagtgcagcacttcgccgtgaacggaggtcgcgacaatgcggctataaaaccaggcgagaggaagctcatccagcgccagtttcgccagccgctctgcctcttccggattgccgtcgttgatggcgacctgggcgcgcagcgcgttaaattcagcatgcagcgtgccgtccatgacccctttgatctcttgctcggcgcgcgccagcagcgtattcacttcgctgtagcggtgttggctttgcatcagccaggcctgtaacaacaccagccgcggattttccagcaggctttcccacggcagcgcttttaatgactcttccagcagcgccagttcactgtgattaaacagcccccacgcatggttaagcaggatatcgcgcagcatttgcgcgtcacccgccgccagcgcatgatgtatagcttcgctgggaaaaccctgttccatccagctttccgcggccgcacggtggatctccggcagttccgccgccagttcccactggcaacgctggcgcagaaagctaccaaacaacgggtgatagctaaaccattcgcccgtgtcgtccatgcgttgcaggaataacccctggcgctcaatctcctccagccgcatctggccgttttcttcgccggtcacgcgcacgatcaacgcgtcattcattgcgcgtaagatcgcgcttttaagtaagaaatgtcgggtgctgacatccacgttatccagtacttcgtccaccagataatcagaaaggtggctggcattaatcccggcaagacggcgggcggagtgatgcgcagaggtatggttctggcgcgcggagagggcgatcaactgtagcgcagtggcccaaccggccacatcatcgcacatgcggctgctctcagcggcttcaatgggcgacgaaagacgacggtcaaaaaattgctttgcttcctgatggttaaaagccaactgctggctgccgatttccaacagctgatcgcgcacgcgcaggttagcgatgcccagttgcggcaaattacgcgataacaccaccagggtgaaattttccggctgatgccgtaagaaaaagcgcatcgcgtcgtgaatcaccggattggtaatcaaatggtagtcgtcaatcaccagataaagcgggcgatgccactgcgccagttcaataaagagctgtgcgaagagagacgtcaggctggcgtactgacgtttttgcgccatcgcttcgctggtagagcagtgtccgccggtggcctgttggatagcggcgattaagtaactggcgaatcgctcttgctggttatcgctttcgtcgagagagtaccagcctaattcatttttgcccgccgcccactgtgagacaagcgtggttttcccatagccagcaggactggttaccaggaggagcctgaaattgttcgcgccggaaagtttagccaacagccgctcacgaaccacggtatggtcgagacgaaccggacgacttaatttagacggaatcaacatagcaatcacttcactgtgggaaatgggggaactgcgatttttttttgcgcttcgtaattaatagatataaggtcggccagaaagcattttaatgcaagctaagcagactttttatgtgtctgaatttgcactctgtcacaattctaaataacggtattaaaaaagtattcggcgcggttgaaacgagcgtcagagctgggctgaggtcatatttccgttattgtaaataatgtcctggacaggatgcggatttaacacaatggcgataccaggcgtttaattaattatgttaagttagtgaacctcccgccgctgaatatttcaggtaataaactattttggcgttcatataatcttcgaaaatatccctccgcggtttactgttatttctgtttattcatttgattatgcgtaacactgggtgtcgttgacaggaatcggcgcgtttatacaggggtaagtggcggcgatcacacttttatgctcatccccgctcctcctccctccctaatcagtgccgggaggaggaaggtcaacatcgagcctggcaaactagcgataacgttgttttattacccgaggacggatttcctatgtcacagccaaccttcaataaagatcaattccaggccgccctgacgcgtcagtggcagcgtttcggtttactgtcggcgtccgacatgacgcctcgtcagtggtggcaggccgttagcggcgcgctggcggaattactgagcgcgcaaccggtagcgcagccgacgaaaggccagcgtcatgtgaactacatttcgatggaatttttgattggccgcctgacgggaaataacctgttaaatctggggtggtaccaggacgttagcgatgtgctgaaagcgcacgatattaatctgaccgatctgctggaagaggaagtcgatccggcgctcggcaacggtggtctgggacgtctggccgcctgcttcctcgattcgatggccaccgtcgggcagtccgctacgggctatggtctgaactaccagtatgggctgttccgtcagtcatttgttgaaggcaagcagatggaagcgccggatgactggcatcgcggcagctatccgtggttccgccacaacgaggcgctggacgtccaggttggaatcggcggtaaagtcaccaaagaagggcgctggaaaccaggttttgtgattacaggccagtcctgggatctgccggtgttaggctatcgtaacggcgtcgcgcaaccgctgcgtttgtggcaggcgacccacgcgcatccgtttgatctgaccaaattcaacgacggcgctttcctgcgggcggaacagcagggtatcgatgcggaaaaactgacgaaggtgctttatcccaacgataaccacacggcgggcaaaaaactgcgcctgatgcagcaatacttccagtgcgcctgctcggtagcggatattctgcgccgccatcatctggccggacgcaagctgcatgagctggcggattatgaggtcattcagctaaatgatacccacccgactattgccatccctgaactgctgcgcgtattgctggatgaacaccagatgagctgggatgacgcctgggctatcaccagcaaaaccttcgcctacaccaaccacaccctgatgccagaagcgctggagtgctgggatgagaggttaatcaaagcgctgttgccgcgtcatatgcagattatcaagcagattaacgatcgctttaaggcgctggtcgataacacctggcctggcgataagcaggtatgggcaaaactggcggtggtgcatgaccgtcaggtgcgcatggccaatatgtgcgtggtcagcggctttgcggtcaacggtgtggcggcgctgcactccgatctggtggtgaaagatctgttcccggaatatcaccagctttggccgaacaaattccacaatgtcaccaacggcattacaccgcgtcgctggattaaacagtgcaatccgcagcttgcggcgttgctggataaaacgctgaaaaaagagtgggctaacgatctcgaccagttgatcaacctcgaaaaatacgctgacgacgccacattccgtcaacaatatcgcgacatcaaacgggcgaacaaagaacggctggtgaaattcatccaggcccgtaccgggattgagatttcgagccatgcgatttttgatattcagatcaaacgcctgcacgagtacaagcgtcagcatctgaatctgttgcatattctggcgctgtacaaagagatccgcgaaaacccgcaggctgaccgcgtaccgcgcgtattcctgtttggcgcgaaggcggcgccgggctattacctggcgaagaacatcatttttgctatcaataaggttgcggaagccattaataacgacccggcggtgggtgacaagctgaaggtggttttcctgccggattactgcgtctcggcggcggaaatgctcattccggcggcggatatttccgagcaaatttctactgccgggaaagaggcgtccggcaccggcaacatgaaactggcgctgaacggggcgttgacagtgggaacgctggacggcgctaacgttgaaatcgctgaaaaggtgggtgaagagaatatctttatctttggccatactgtggaagaggtcaaggcgctcaaagccaaaggctacgatccggtgaaatggcgtaaaaaagacaaagtgctggatgcggtactaaaagagctggaaagcggtcaatacagcgatggcgataaacatgcctttgaccagatgctgcatagcctcggcaaacaggggggcgatccgtacctggtcatggcggacttcgccgcttatgtcgaggcgcaaaagcaggtggatgcgctgtatcgcgaccaggaagcgtggacgcgcgccgcgatcctcaataccgcgcgctgcggtatgttcagttccgatcgctctattcgcgattatcaggcccgtatctggcaggcaaaacgctaagggagcgcgatggaaaataaacgtctcgatagtgccgcgctggcggcggggatcagccccagttacatcaatgctcatggcaaaccgcagtctattggcgctgaaaccaagagacgtttgctggcggcgatgcacggcacgacaacaggaccacaggcggtcgtgccgaatgtgaaggtttataccgcgggtaaaaaaatggcgttgccggtagaggggcgcggtgagtttgcctggctgctgactacggaagagggcgagcattacaaagggcgcgtgacgggcggtaaaaaacttaacctgccggctacgttgccggagggctaccacaccctgacgttgacccaggatgaacagcgtacgcactgccgtattatcgttgccccgccgcgatgctatgagccgcaggcgctgttggaggggaaaaaactgtggggggcctgcgtccagctttatactctgcgttcagaaaaaaactggggtattggcgatttcggcgatttgaagtcgatgctggtcgacgtggcgacacgcggcggcgcgtttatcggcctgaacccgatccacgcgctttatccggcgaatccggagagcgccagtccctacagcccctcgtctcgtcgctggctgaacgtgatatatatcgacgtcaacgccgtcgaagatttccgcctgagcgaagaggcgcaggcatggtggcaaatgcccgccacacagcaaaagctgcgacaggcgcgcgatgcgcaatgggtggattacgctaccgttaccgcgctgaaaatcacggcgctgcggatggcgtggacgcggtttgccgctcgcgacgatgcgcaaatggcggagtttcgtcactttatcgcccgcgaaggcgaaagcctttactggcaggcggcattcgacgcgctgcatgcgtatcaggtgaaagaggatgggcagcgctggggctggccagcctggccggaggcgtaccagtcggtagagtctcccgctgtaaaacaattctgtgaagcgcaccgcgaagaggtggagttttatctctggcttcagtggctggcctggcgccaattcgccgcctgctgggatacctgccagagttttaaactaccgattggtctgtaccgcgatctggcggttggcgtagcggaaggcggcgcggaaacctggtgcgaccgggagctgtactgcctgaaagcatctgtcggcgcgccgccggatatcctcggcccgctcggtcagaactgggggctgccgccgatggacccgcatatcattgtcgcccgggcgtatgagccctttatcgacctgctgcgcgccaatatgcaaaactgcggcgcgttgcgcattgaccatgtcatgtcgttgctgcgcctgtggtggataccgtatgacgaaacagcggatcagggggcttacgtccattatccggtagatgatttgctttctattctggcgctggagagccaacgtcaccgctgtatggtgataggcgaagatctggggacggtgccagttgagattgtcggcaagctgcgcgatagcggggtctattcttataaagtgctgtggtttgaaaatgaccttgagaaaaacttccgcgcgccaggcgcatatccgcaacaatcgatggctgtcgcctcgacgcacgatctccccacgctgcgcggctattgggaatgcggtgacctgacgttgggtaaagctctggggctttatccggatgaagtgattctgcgcgggctgtatgaggatcgcgagcgggcgaaacaggggctattggacgcgctgcataaatatggctgtctgccaaaacgcgccgggcataaggcattgttaatgtcgatgacgccaacgctaaatcgcggacttcagcgctatatcgccgacagtaacagcggtctgttggggcttcagccggaggactggctggatatggccgatccggttaacgtaccgggcaccagcgatcagtataaaaactggcggcggaaattgtctgcatctcttgaggctatgtttgccgatgagggcgtaaacaagctgattaaggatttggataagcgccgaaaagcggccgcgaagaagaagaagtaataaagccggggatttccccggctttatgatggtgagagcacgtaggcctgataagcgcagcgccatcaggcaattctggcgcacattgctgccttatccggcctgcaaaccgcctcgcttaaaccaccatacccagtagcagacagccgatcaggccgcagacggagatgatcgtttccagcatcgaccaggatttaatggtctcgccgatagtcaaattgaaatactctttgaacagccagaagcctgggtcgttgacgtgagagaaaatcacgctcccggaaccgactgcgataaccatcagttcaggactaacgccggtcgtggcgatcagtggcgccgcaatgccgcctgcggtaatcgccgcgacagtcgcagagcccagcgcgatacgcagcaccgccgcgatagaccacgccatcaacagcggagagacattggtttcatgcatcattgaagcgatgtatttatccacgccgctatcgaccagcacctgcttgaacgcgccgccgccgccgatgatcagcagcatcatggcgataattttgatggaagagaccagcgtatcgttaatctgatccattgaacgcccgcggttcaggccaaaggtgaacattgcaatcagtacggcaatcaacgtagccattaccgggtcgcccaggaactcggcaacgggcaggaaagcgtggccttttggcagaatcatctcggcaaccgcacgcatcgccatcagaatcaccggaaccagcgacgtccagacgctgacgccaaagcccggcatctcttcttccgtaaaggttttcgcgctgtacaggccttccgggatcggcttatcgatgcctttcagaaaacgggcgtaaaccggtccggcaaggatcacggtcgggatcgccagaatcgtaccaaacagcagcgttttacccatatcggcatggaaaatcgtggcgatcgcggttggacccgggtgcggcggcaggaagccgtgtgtgacggagagcgccgcggccatcggcacgccgacgtacagtaacgggatattcgccgctgcggcaatggtgaataccagcggcagcatcagaacgaagcccacttcatagaacagagcgaagccgacggtaaagccggttaacactacggcccactgaatatgctttttaccaaatttcgcgatcagggtagtggcgatacgttgagcgccgccgcagtcggcaagcattttgcccagcatggcgccgaaccccataatcagggccagactgccaagcgtaccgccgacaccggctttgatggagccgatgactttatccagcggcattccctgcatcaacccgacagcgagcgctaccaggacaagggcgataaatccgttcattttgaagcggatcatcagaagaagtaacaagataacaccgatagcaacgatgactaatggcatgatttacctggcctttactttgttatgggtaacgtcattgtttcgacgacaaattcctgttgttcccgacgggaacagagtcgcaatagcaccaatactgattaccgttgaaacgaatgagcgtagtcagatgttatatggatgttaggtgcccataagaatgatacgggtaacatatgggtgttgaaaatgaccctggcaggcaaaatttaaattatgagacacaggtcatgttatcggcgaaagaagaagaaccattgttctgagatgtggctgatggcgcagaatggcggcgtagacgccttattcggcctacggtggggcagacaaggcccgacaggcgcaagcgccatcgggcatggatgcggggaaaatcttagtagtatgagtgctcgccgcgctggtgttcggtcagatcgcgaacccctttcagttccgggaattcattcagcaactgtttctcgatcccttctttcagcgtgacgtcaaccatcgagcaaccgttacaaccgccgccaaactgcagaattgcatagccttcatcggtaatttccatcagcgagacgcgaccgccgtggcccgccaactgcgggttaatctgcgattgcagagcatattccacgcgctccatcagcggcgcgtcatcggccactttgcgcatcttcgcgtttggcgctttcaatgtgagttgagaacctagctggtcggtcacgaaatcaatttccgcgtcttccagatagggcgcgctcagctcgtcgacataagcggtcaacaggtcaaatttcagtgcagtatcggtggcttctacggcgtcgggcggacaataagaaacgccgcactctgcgttaggagtgccgggattaatgacaaatacgcggatttgcgtcccttctttctgatttgccagcagtttggcaaagtgcgcttgtgcagcatcggaaatacggatcatagtaatggcctaatagttgactattttagttggttataatacgcccgtcatcgaggctctacaaggttcgacacaggcaccatacctggacagtcgctgcgccgttgcgcaaaagcagttgcgcgatttccgcgacggtacttccggtagtgacgacatcatccacaataaccatatggagaccctgtaccggcaattcaaggcgaaacgcgtttttcaaattgcgcttacgtaacctggcgctgagatgatgttgtgttgcggtcgcccgtacccgcgtgatggtctggctgtcccacgcgcagcccagccagtgcgctaacggttggcataacagatcgctttggttaaatccccgccgccagtgtcggcgcgaccagagcggaacgctgacgattctgtcgggaagcggcaagccagtgctgcggcgcgccataagtacttcctgcaacagtagacgcgccagagcggcggcaatttcgctgcggcgggtaaatttaagctgatgcaccagtaaactcaagggcggcgtatagtcactgacgctcaccagacgctgccagggcggcggtttttgcaggcagcgaccgcaggggagcgaaggatgcccggcaggtaatccgcattgcggacacaggctgacgcgctgacgaacggcgcgcgcgcatacggagcaaatcccccagtggcttaacgccagcggcattcggcatagccagcataatcccggtactgttagcataggtgcatccttgttagacaaaagagaacagtaactgatgaatgacatctggtggcagacctacggcgagggaaattgtcatcttgtgctgctgcacggatggggattgaacgcggaggtgtggcattgcattcgcgaggaactcggctcgcattttacgctgcatctggtcgacttgccgggctatggccgtagttcggggtttggtgccatgacgcttgaagagatgacggcgcaggtagcgaaaaacgcgccggaccaggctatctggcttggctggagtctgggcggcctggtggcgagtcagatggcgctcacccaccctgaacgcgttcaggcgttggtgacagtcgcctcttcgccatgctttagcgcgcgtgaggggtggccgggaataaaaccagaaatcctcggcggattccagcagcagcttagcgacgattttcagcgcacggtggagcgttttctggcgctgcaaacgttagggacggagacggcgcgtcaggatgcccgcaccttaaaaagcgtagtgctggcgcagcctatgccggatgtagaggtgctcaatggcggactggaaatcttaaaaacggtcgatctacgagaagcgcttaaaaatgtgaacatgccgtttttgcgtttgtatggttatctggacggtctggtgccgcgtaaaatcgcgcctttgctcgatacgttatggccgcacagtacatcacagataatggcgaaggcggcccatgcgccgtttatctcgcatccggcggcgttttgtcaggcgctgatgacgctaaaatcatcgctgtaaccagggcgttgccgggcccaggccattctgccagattaatggctttcagacgccagatcggcaggcgccagcccggtaaccctaagcacagtatcgcgatcgaaaccatcgtttagcatggagcgggcaatgcgcaatgcggcgagccgttggcctttctgtttgccttgttgtagccctttctgtaacccgttacgatgtccttcctgacgtaatctttctgcgatagtcatgatcttctccttatgctgtgggatacgcatagccacctggcggataaacgtattgaagcgcgcggcgtcgccagtgtgcatcatgtaattaaacagactttgaagctgggtgtcattagcgtatcccttaaccagcagggcgaccagctgttcgacaagccccatcagatcacgctggcggatgtgtttttgtatgagttccagcagcgcgacccgtcggtgccgcataatctcgtcgtccggcacgaccgtaatatcgaccagaggaaaggcggtggcgtatagcttacgcgccatcaccgggtcggcaaattcatccagccagcataatgagaacggatacgggcttcggtttccgtggtaaaacagcattggcaccactaatggcaacgtcttatgcccggcctccaggtgccgttgcattgcagccattgtgtaacgcatcagccgaaatgccatatgcgcgtccggcgtactctgatgttcaataaccacgtaaatgtaaccgtcaccttcacttgtttccagcgaccaaaggatatcggaataatgggggcgtaaatcctcttcaataaagctaccggactccagccgtaacgtattcagattacagatttgacgtaatgtcgacggaagatggatttccaaaaaatcccgtgcagtatcggggtggcataaaaactgtttgaataccgcgtcatgcggcgtggatgttgttgaggtcgccatatcgatccgtcaccggtgaagctcaatggcgtgacactacgcgcagaccgggctgattgcagtagaggattagtgcgcttgcgaggcgcgtggggagataaatgcgcacggcggtaacgctttcatctttgtggaaggcatgacgcaaaattgcccggcagcgtgacgcgtaccgggcaatataacgcgggataaaggccggataagacgcgttacgtcgctacccggcgaaggtcaacgcaaggcccaccattcgcgcaggcaggctttaccttccggacagcttttacaactgcctgaaaggcaaccgtccggttcttccgggatacgtaccgctttacccatgatctccagttgattcagcatggcgtcgatcatgggctgcggagcgtgcagcgtatggctgatctgcgttgcctccatacgcccccgcagcgccagtagatcgcgaacctgtatcaatgaagccattttttacatcccttagtgacaattgcccgcagtgcccgaacaacaggatgtgacgcttttgcgggttgccagcagttcaatgtctacacggctgcgggcgcggcgtagcagacttaataccacaacgttaaagacgattaccgccagaatacagatcaggctgtaagtcgggtgctgactgaagctagtaacctggtagaacagcgtggcgagcgaataggcgatattcagcccccacaggatggagaagctcatccagccgcggctggactcgcgggcgatagcgcccattaccgagatacacggtacgtaaagcaggacgaaaatcaggtaactgtacgccgccgcggcgctgccgaatttttgatccatcacgcccatcgcgccggtcgtcatttcgccgtcgcctttactcgcttcgatcgggttagccagtacgctcaggctaaaggtgtctttcaggctttgccaggtatcgtcaaccgcgcccagcagttcatcgccgaggtgaaagtcggcaggattaaacgcttcgtcctgaatattttcggcggtgtagagcgtgttcagcgtaccgacgacaacctctttcgccatggcgcccgtaaacagacccacggtagcttgccagttatcctcatggacgccgatcggtttaaagactggcgtgatgacccggcttacagaggcgagggcggagtcattaatgttatcgacgattttgccgctcagcgagaaactgttaaacgcgctcaggaaaatactcacgatgataatgactttaccggcgcgtagtacaaaacctttcaggcgttgccaggtctggatgatcaggctcttgatatgcggtacgtggtaaaccggcagctccatcacaaacggagaggcttcgccacgcataatggtatgtttcagcatcaggccggttaataccgccatgacaatacccagcacgtatagcgagaagaccgccagcgcgccgttttgcccgaagaaggcggcggcaaagacggcgaaaatcgccaggcgcgcgccacaggacataaacggcgccatcatgatggtcatcaggcgttcgcgcggagcgtcaagcgtgcgggcgcccatcacggaaggtacgttacagccgaagccgacaatcagcggcacgaaggatttacccggtagtcccagcgcctgcatcaggcgatccatgacgaaggccgcgcgcgccatataaccggagtcttcaaggaaggagaggaacaggtacatcatcccgatttgcggcaccagcggcaggacggtattgatcccgccgccaagaccttgcgtcaggaagatggttaaccaatccgggaagtgcagcgtgtagccaatccattgaatgccatgaataaagatggcgacggaaccggcatcaaacaggggttgcaacgcgccgccgatgttaatggcgagcaggaacatcaggtacatcacgaacaaaaaaatcggtaagccgaggaagcggttcaggataattttatcgaccgccctggtgaagcggctgggttcggctgtcagggtattgctgaccacgtcgcaaatagcggcgatacactggtaacgggcgtcggcgatatgcagcgccgggtcgtccatttcgtccttcagacgggcaagggaggtgtccaggttttgcgccgtctcgcctgcgtaagcccggctgtagatatcgccctccagcatttgcagacccagccagcggcgctgttgtaaaggcatctcctgggccatcgcgtcggccaggaaacccgcttcgcgcagcagcggctgggcataatgcaccagttcgacgttgtcgttagcgttgtgacgatcaatggccagtttcagcgcctcgataccgcgaccgcgagtcgataccagcggtacgacagggcaacccagacgcgtggacagagcgtcgacatcaatacgaacctgctgtttttcggcgatatccagcatgttgagcgcgacaatacaggggatacccagctccagcagctgcagcgtcaaatagaggttgcgctccagattggaggcgtccacaacgtttatcaacaggtcggcgtcgccgctcaggatgtagtggcaggcgatctgttcgtcgagagaggtttgtgacgagatggtcgtcagagaataggtgccgggtaaatctaccagcgtgacctggtggtcagttgtcgcgaactggccctctttacgctcgacggtgacgtccgcccagttccccacgcgctgacgcgcgccggtgagttggttaaataaggtggtcttgccggaattaggattaccaattaaaccaatggttaattttttcatttttatagactcactgtattaacaggaaaccgcttccacttctattaacgccaaatcctttttacgcaaaaccagactcacgcgtcgtgtttcgatatggatcggatcccctaagggcgcgacgcggacaacattaaatgaagagccgggcaacatgccgagcgaaagcagtttttgacgatacgccgggctgatttcacgcgcaaagccggtgattttccacgcagtgtcaggagtgaattgcatacgacctacttgtttcttactaactggatgtatacctcatgcggcgctcaggggggcggcaggagacccgatgtttagccaacgaaggaaagagtaaataatcaacaacacaatgataatgagaatggtttctatcttcaacgattaaaatgtgacggaatgtacaaataagcgataatttgcgccgatgttgatatggctcaacatttatttgtctttttgcaaatacctctaatgtgcaaatattcaccgtttttaatgtttaattaaggtttcatctgttaataaagtgataattaatagtgcggatagcagaaggaaattaattaacagattctaatgggtaagatttaattgttaattaaaaaagaaagggttggacgtattgcaaaatcgcaggccggataagaagtaacccggcctgcgtattacccgattagcgtttttttcccattgccgctgccagcgcgtccatcatggcgctgttaccggctggctgggcgtcacgaccgcgcggtttcgccgcttttgacgccgggcggttgccctgagcgcgatcggcaccgccgccgcggcgagcggcggtttcgccgggctgttcgtccagacgcatcgtcagcgcaatacgcttacgttgcagatccacttccagcactttcaccttcacgatgtcgccagcttttaccacggtgtgtggatcgtcgacgaacttagtcgacagggaagagatgtggaccaggccatcctgatgaacgccgatatcgacaaacgcgccgaagttagtgacgttagtgactgccccttccagaatcatccccggcagcaggtcgttcatggtttcgacgccatcggcgaattgcgcggttttaaattcaggacgcgggtcgcggcccggtttttccagctctttgatgatatcgttcacggtcggcacgccgaatttatcgtcggtaaaatcagcggccttgaggtgacgcaattcgttgctgttgcccatcagatcttttagcgcttgctgcgtcgccgccagaatgcgttcgacaaccggataggcttccgggtggacggtggaggcatccagcgggttatcgccgtggttaatacgcaggaagcccgcgcactgctcaaacgctttcggccccagacggctcaccttcaacagttgctggcggttctggaactgaccgttctcatcgcgccaggcgacgatgttttgcgccatcatgcgcgttaagcctgcgacgcgggtcagcagcggtacggaggcggtattcaaatcgacgccgacggcgtttacgcagtcttcgaccaccgcatccagtttacgggccaattgggtctggctgacatcgtgttgatattggccgacgccgatcgatttcggatcgattttcaccagttccgccagcggatcctgcagacgacgcgcgatagagaccgcgccgcgcagggagacgtcgagatccggaaactcctgcgccgccagctcagaagcggaatacacggacgcccccgcttcgctgacgatcactttctgcgccgtcacgttcgggaactgtttctgtacgtcgagatagaaacgttcggtttcacgcgaagccgtaccgttgccaatcgcgaccagttcgacgtggtatttttcgcacagcgcggcgatcacggtagccgctttggccgcctgaccggtatgcggataaatggtatccgtcgccaccagcttgccggtgccgtcaacgacagcgacttttacgccggtacgcaggccaggatcaaggcccatcgtggcgcgcaggcctgcgggggctgccatcagcaggtcgtgcaggttacgcgcaaacacgttaatcgcttcgtcttccgcacgttcgcgcacggtgcccatcagttcggtttcgaggtgcattaagactttgatacgccacgtccagctcactacgcctttgcgccagctatccgccggggcgttatttagccgcaggccgagatggtccatgatgatttgctcgcagtagctctctttcggcggctcatcaaactgtgggtcggcattgagcgaaagttgcagaatgccttcgttacgaccacggaacatggccagcgcacggtgagacgggacgttagcaatgggctcatgatggtcgaaatagtcgcggaattttgccccttcttcctctttgccgctcacgactgtggcgaccagatgggcattcttccacaggtaatcacgcactttcgccagcaatgcggcgtcttcggcaaagcgctccatcagaatgtagcgtgcgccgtcgagcgcggctttcgtgtccgccacgcctttgtcgccatcaatgtactttgccgctttcacgtcaggatcgtgggacggttcgttccagagcagatcggccagcggctcaaggccggcttcaatggcgatttgtccacgggtgcggcgtttaggtttatagggcaggtagaggtcttcgagctcggtcttacttaacgtagcgttgatggcgccagccagctcatcggtcagtttgccttgttcggaaatggacttgaggatggcctgacgcctgtcttccagctcacgcagatagcccagacgcgtttccaggttacgcaactgcgtgtcatccagaccgccggtgatttctttacgataacgtgcgataaacggcacggtgttcccttcgtcaagcaggcgaacggcagcttcaacctgcccggcatttgcctggatttcacccgcaataatgcggcagaaagaatcattcatcatgggttagcttcgtcttcaggataaaaatcaggggatagttatacggattggctggcaaaaatgccagccatcagcgggggcttaggattcttcttgtcttatttgacgtattcgatcgcattgacgtaccagtttgcttcgccgacaggggtgttgaccaccgccagatcgcccacttcttttttcagtagcgcccgcgccatcggcgagtcgatagagatgtaatccttacgtccgaaaatttcatcgtagccgacaatgcggaacttcagcgtatcgccgtcatcattttcgatttccacccaggcgccgaagaagactttgccctcctgctgcggggaataatccacgattttgagattttccatgcatttggtcagatatctgacgcgtctgtcgatctcacgcaggcgctttttattatactgatagtcggcattctcgctgcggtcgcccagactcgcagcccaggtcacttttttggtgacctccgggcgctcttcacgccagagataattgagctcttgtttgagtgtttcgtacccttcgcgggtgatcaggggcgttttcatctcgttgatttacctttgctgtcgatattgcgcacacggggtataacgtgatcgtcccgacagaataaataatggggttgccgattaattgtatatttaagctgctgttaaatatgctttgtaacaatttagcctgaaattcataccagaatttgctggtgactcacgtgagcttttttaagaatacacacttacatttgttgcgaacctttgggagtacagacaatgcaagagaattataagattctggtggttgatgacgatatgcgtctgcgggcgctactggaacgttatctgaccgagcagggcttccaggttcgaagcgtcgctaacgccgagcagatggatcgtctgctgacccgtgaatctttccatctcatggtactggatttaatgctgccaggtgaagatggtctgtcgatttgtcgtcgcctgcgtagtcaaagtaatccaatgccgatcattatggtcacggcgaagggtgaagaggttgaccgtatcgtcgggctggaaatcggcgccgatgactacattcctaaatcgtttaacccgcgcgagctgttggcgcgtatccgcgccgtgctacgtcgtcaggcaaacgaactgcccggcgcgccgtcgcaggaagaggccgttatcgcgttcggtaagttcaaactgaacctcggtacgcgcgagatgttccgtgaagatgaaccgatgccgctgaccagcggggagtttgcggtactgaaagcgttagtcagccatccgcgcgagccgctctctcgcgacaagctgatgaatctggcccgtggccgcgagtattccgcgatggaacgctccatcgacgtccagatctcccgcctgcgccgtatggtggaagaagatccggcgcatccgcgttatattcagaccgtatggggcctgggctacgtcttcgtaccggacggttctaaagcatgaggcgaatgcgcttctcgccgcgaagttcatttgcccgcacgctgttgctcatcgtcaccttgctgttcgtcagcctggtgacgacctacctggtggtgctgaacttcgcgattttgccgagcctccagcagtttaataaggttctggcttacgaagtccgtatgctgatgaccgataagctgcaactggaggacggcacgcagttagtcgtgccgcctgcgtttcgccgggaaatctatcgcgagctggggatctctctctacaccaacgaagccgctgaagaggccgggctgcgttgggcgcaacactacgaattcttaagccaccagatggcgcagcaattaggcggcccgacggaagtgcgggttgaggtcaacaaaagctcgcccgtcgtgtggctcaaaacctggctgtcgcccaatatctgggtgcgcgtgccgctgaccgagattcatcagggcgatttttctccgcttttccgttacacgctggcgatcatgctcctggcgataggcggcgcgtggctgtttattcgtatacagaacagaccgttagtggatcttgaacatgccgccttgcaggtagggaagggaattattccgccgccgctgcgtgaatatggcgcctctgaggtgcgctctgtgacccgggcgtttaaccatatggcagccggcgtgaaacaattggccgatgaccgtacgctattgatggcgggcgtcagccacgacttacgcacgccgctgacccgtattcgtctggcgacggagatgatgggcgaggaagacggttatctcgcggagtcgatcaataaagacatcgaagagtgtaacgccattatcgaacagtttattgactatctgcgtaccggtcaggaaatgccaatggagatggcggatctcaattccgtgctgggcgaggtgattgcggcggaaagcggctatgagcgtgagattaacactgcgcttcaggcaggcagcatccaggtgaaaatgcacccgctctcgattaagcgcgcggtggcgaatatggtggtcaatgctgcccgctatggcaactgctggattaaggtcagcagcggcaccgagtcgcatcgcgcctggttccaggtagaagatgacgggccgggcattaagccggagcagcgtaaacatctgttccagccttttgtgcgcggcgacagcgcccgtagcaccagcggcacagggctggggctggcgattgtgcagcgcattattgataaccataacgggatgctggagattggcaccagcgagcgtggcggattgtcgattcgcgcctggctaccggttcctgtggctcgcgtccaggggacgacaaaagaggcataagaaagggaggtattaccctccctttcttcttaacactggatgacgctgttcaaagccgccatccggcctgttccttacagcttcggtccggcgctaaccagcgcttcgcctgccggggtatccgtatacttctcgaagttctcaatgaacagtttcgccagcgcggtggctttttcctgccattgttccggcgacgcgtaggtgttacgtgggtcgagaatgtgggtatccacgcctggcagttcagtcgggatcgccagatcgaacagcggcaggcggaaggtttccgcgttatcaagagaaccgttcagaatagcgtcaataatcgcgcgcgtatctttgatggagatacgtttgccggtgccattccagccggtgttaaccagataagcctgtgcgcctgctgcctgcatacgtttcaccagcacctcagcatactgcgtcgggtgcagcgtcaggaacgcggcgccgaagcaggcggagaaggtgggggtcggttcggtgacgccgcgttcggtgccggccagtttagcggtgaaacccgacaggaagtggtactgcgtctggttagcggttaaacgggaaaccggcggcaacacgccgaaagcatccgccgtcaggaagataaccttggtggcgtgacctgctttggatacgggcttaacgatgttatcgatatgatagatcgggtaagagacgcgggtgttttcggttttggaaccatcgtcgaaatctacggtgccgtcttcgcgcacggtgacgttttccagtagcgcatcacggcgaatcgcatgataaatttctggctccgcttctttcgacagtttgatggttttggcgtagcagccgccttcaaagttgaacacgccgtcgtcatcccaaccgtgctcatcatcgccaatcagacgacgtttcgggtcggtggacagagtggtttttccggtaccggaaaggccgaagaagaccgcgacatcgcctttttcacccacgttggcggaacagtgcattgaggcgatacctttgagcggcagcaggtagttcattaccgagaacatcccttttttcatttcgccgccgtaccaggtgccgccaataagctgaatacgttcagtcaggttgaacgccacgaagttttccgagttcagcccttgctctttccactgcgggttggtgcacttcgcgccgttcatgacaataaagtcaggtttgaagcctaccagctcttcgtccgttgggcgaatgaacatatttttaacgaagtgggcctgccaggcgacttccgtaataaagcgcacggaaagacgcgtatcggcatttgcgccgcagaacgcatcaacaatgaataagcgtttaccggaaagctgatgcgtcaccagacctttcaggtgttgccaggtttcctgggaaagcggcttattatcgtttttacctttacccttatcggaccaccacagcgtatcacgcgtggtgtcgtcgcgaacaatatacttatccttaggcgaacgaccggtaaaaataccggtatcaacggcaacagcgcccaggttagttaacacgccacgctcatagccttccagaccaggattaagttcttcctgataaagggtgtcgtagctgggattgtaaacgatatcctggacgtcgttgataccataagccttgagatcttgcggggttaaattgttaacgcgcatatcactgctccttagccaatatatattaccgaaaatagtaaggttttttgaggttggttaaccgcgacaaggctcatagatttacgtatctggacaaaatcacgattgacgaaaaacactgtgactcctgtcacgcagcggcggttattatggcaggaaacctacttttgttgtggaaaatgttctgaaaacgttaaaaggaagtgtttttgaccgacataatgtgactgtaatcgcattcatgtaagaaagttacgtaacaccaacattaacaatatcgattcacctctctgcgtttttttctgaattatgcatgacgacgcctggcggtgaacagatggtgcaataatgcggctttctcatcattctggataacgacatggaaagtgtagcgctttcacgtactactcgctggggtatgttgctcactggtttgctgcagggcgtcttgtgctacctgctgatggcctggctggtaccacaaaatagcgactggctgttctatggtatgcctgcgacgatagcgttgtcgtcaatgctattgcttaccgtggtctcttttaaacagcgcgcgctgtggggctggctggggctgatctttgtggtcgtgctggcaatgagcggctggctgaaatggcaggttgaggcggtggagaaatggcgcctggccgagctcctctggctgtatggtcttcggcttgtgttgatggcgatgctggtattaccctggatgcaatatcagttacattcgcaaaccggttcggcgcgttatccccagttttatctgcggttatggcataacgtactgacattgtttatcgtcctggtcgccaacggactgttctggctggtgcttctgctctggagcgcgctattcaggctggtgggcatccgctttttcagcacccttttctttgaaactgaagcctttatttatgtgaccatcggcctgattacggcgctggcggtcattctcgcccgcacgcagtcgcgccttgtggcggcggtgcaaaagctgctgacgctgatcgcgacgggtttactgccagtggtgtcgctgctggcattgctgtttattgtgacgttaccctttaccggactggaggcgatttctgcgcgtgtttccgctacggggctgctatccacgctgacgctgatgctgctgctcctcgtggcgattgtcaacgaaccgcaaaagcgcgtattaccctatccgcgcgtactacgcggcatgattagcgcctcgctgtgcgttgccccgatatatatgctgctggcgggctgggcgttatgggtacgcattcagcaatacggctggacgccggatcgtctgtatggcgcgctgacggcgtctgtcttgctggtatggtccttcggttatctgatcggtctgttacgccgcggacgcgaccctgatgagtggcaaggcaaggtgatactgagcgtctctttgttgacgctggtgatattgctgttgctggcctcgcctgtacttgatgtctggcgtattagcgtcaacagccatatggcgcgttaccatagcggtaaaattactgcggatcagatcagcctgtatatgctggatcacagcggcaaacctggccaggaagcgctgaaatcgttgcgggatgacgaggcgtttacgcagaacagaaagcgcaatcgtgaactgatgacgtttttgcagagaaataaggtccctccgacggcggacgatttagcgcgggtggtgatgattgcgcccggtagccagaagccggatgccgcattttgggcgtttgtcaaagagcagagttattcggacgcttcctgccttgaaccggatgcctgcgtgctggtgagtcaggatcttaacggcgacggtcagcctgagcaggtgctgtataactttattgttgccgagagccaggtctacggcttaaaagaggggaaatggacgcagaaagcgttcgcccgattgccggacgggttttctaagacgcaactgttgcacgcgattgccgggcatcggttagactcagcccccaaagcctggcgcgatatcattgttgatggtcagcggttggatgtggattactacaacgagtaagctttttgccggatggcggcataaatgccttatccagcctacggagcgggatgctgtaggccagataagcgtagcgccatcaggcaatgacgctgccgactacgaggcgattaatgaacctgtggatcggcaggagaggcgttgttacggatctccgcgatatccatcgcattgaacaggtaatgattgccgcagtaatcgcagtgcatatcgatttcgccttcttccgccagaatgctgtccacttcttcatccggcaatgttttcagcgcgcccgcgcaacgttcgcgtgaacaggtgcatttgaattcaacctcttgcggatcgtagagcgtgacttcttcttcgtgatacaaacgccacagcacgtcatttgccggtaatgtcagcagctcttcgcttttaatggtttccgtcaacatggccagatggtcgaaatcctccgcctgcgcgttctgtgccggcatcacctggagcaacattccacctgccgccggtttaccgtcgacatcgccggtacggataaacaggcgcgtcggcaactgctcggagcgcaggaagtaatcttccaggcacgccgccagagtatcgccttccagacccaccacgccctgatagcgttcaccctcttccggcgtaatggtgatcaccagatagccgttgccaaccagcgttttgagatccgcattgtcagggatatcgccctgaacgcgagccacgccgcgcatctgctgctgattattgccattgatcaccgccaggcttaacggcccgtcgccctggagctgtaccgtaatgtcaccggcaaacttcagcgtcgcggtcagcaggctagtggcgaccagcagttcggccagtacggttttcaccgactgcggatagttatgattgtcgaggatctgttgcaaggtttccgaaacggtcaccagctcgccgcgaacggcaaagttttcaaacagataacgatgtaattggtcatgttgcggcataatcatctttcttgcgggtgacagttattcgctgtcgccgtgtttaaatcgtaacaggtcgcggtgctctttcttgtccggtcgcctggccggatgcggcatggtcagggcgttaagcttgcgcgcctgcgccattttttcgcgtttttccacgctttccgccgtctcttcatacagagcgacggcttcgctggccggacggcgctgttcggtgatggctttaacgatcaccgtccgttcgtcatttccctgacgcagggtaagggttgcgttcagctcgacgattttgctcggcttactgcgctggccgttgtaatgcaccttaccgccttcaatcatctcgcgggccagcgcgcgggttttataaaaacgcgcggcccacagccatttatccagtctgacctcaacggaggacttttctttcatggcgtctccttcacttcagcgaggggatcagacggcggtagtcgttcagggacggatggcgcgtatagtgcttttccgccagaccggaatcgggattcgtcacgccaagacagtagcgaataccaaaccgggcggcggcgtcgagaatcggttcgctgtcatcgataaacagcgttttctctgcgcttattcccgtttcctcagtgacagcgcgccataaccgctgatcctctttgggataaccaaatgtgtgggtggaaagtaataaatcaaggtgtgaggccagaccggtatgctccagcttcaccgccaggttatgtggatgcgcattggtgagcagaatccgacgttttccgctggcttttaacgcattcagaaacggtacggtatcgtcgcgcaaaacggcgcgcggcccttgcgccgtcgtcatggcgcaaatatccagacccagacgctcgctccagtaatccagacagtaccagtttagcgtatgctgtacggcatgatactgctggcgaatatattcctgcgcgtcttgcggcgaaataccctgctgcgcgccgtaggtttccggtaccagcttttgccagaaatagttatcgaacgcgagatcgagcagcgtgccgtccatatccagcaaaacggtatccacgttttgccagtcaatatcaatatgcatggggaactccagggtaacgcaatttgcgcgacagggtagcataccctgtcgcacggcggcgctatcagatgagattttccggagagacggttaacctgggattgaggcagctttcatagtattcctggatgtccgccatacgggtatggtggcgttgataacgcctgaacgcctgaatgccgttgtagaccgcgctcactatcattgccagcatcagcagcgtggtgccgaggtaacgccaccagccggatttatcggggatacgatgcaggctgatatgctgcgtgccgttggcatcggtatacacgctggtgacaatgccctcggcgctaaatggcgtctgcatgagcgtttgcgccagacgctggaaggcgctccactgttcctgcgcgggatagtcatacagcggcgttgacggccaggcctgatcaaccagttcgctgccttcatcgctggcgatcaggaatccgccgggagcggggctattcagcgactgggcggcacgcgcggtctcgcgagaaataaacggcgccgttgaggtcgtgaccagattttccagcgactctgcgcttacggggcgtagcagcacgttgacgccgtccagtttgccggcgttcgcgcgtttcaccagcgcgttccagtccttactgttaccgagattaaccagcgcatttttcaggcgcacgcactcgtcttccgccgcgcacaaatcagcggttttcagaacaatatcgccaaagtcatctaataataccatgcccgatttttggatcgcggagcgtaaagatgcgcttacgcgcgagtcgtcttcgggttttggatggagctgacgatttaccgcctggcttagcgccatcgctttattcaccagatctgattccggcagcggtagcgcaggcgcgtcattccagatgatttgcgagcaatcgaacggcataaacggtgagttagactgcccgctccaggtcgccccggaatgaatattacacattcctttaccgctcaggtgcagcgtatcgcccacccgtacgccagccttttcaagctgttttaccgttgtcgcttcaatggtttgcgcgcctttcatccacgatagcgtgaacttgattggcatatccaacgggatccagaacagcagcataaacaacaccagcagcgaaccgatagcaataacagtgctgcgtaaccagtgctgcaacgggaagtttttcacttcatcatgcagggataaaaaacggccctggcgggcgacatggcgatcaaggtaaatatcaatatccgtttgttgcccaagatcctgcgtaatgtaaggttgccagtgggcagggtaaataaggtcgatgatgcccagggaaatattgttaatctgctcctgattattctccccaaacagtccccagcggcggggcgttccccgcagacagtgaatttcccgcagcgcgcttttcgacggcggcgcaaaaagcccccaaagtccggctgccagcagcaggatcgcgccgcctatcatccacggtacaaaaacgtctggcgttatcagacagaaaaagaataacaaaaaggaggcgacgattaacaatgcttcgcgcaagccagccgggcggctgagcgcatattcttcgtgggtctcctgacggatgttcaacagctcaatctgctcgctctcttcgccgcgaatcgacgcctgcgtagaggccgtattctgtagcgcgtagccgcgcgactcctgcatatactcttgcagcgtatggccgtttaaagagatcaccagcggcagcgtatccgtgaggattagctcaacgttgttttcatcattgatgtactgttcccagaaaggcggcagatggacttcgacggagtcgaggtagtagcgccatttattaggatcgtcagtggtaatgccgtagcgggtgatggagtgggtcagtatcacgacactgttgctttccgcgttcagcgtcagcgagatgggcgcagcactggcgcctgtcggccccggaacttgctggatctggctaaggttatcgagatagttttctaccgcgctgcgctcttcgggcaacagtttacgcgtttgcgcgtcctgaaaggcgctgaaccacggtaagctccctcgtctggactttactcggaaccgccatattgccagtagagagcaggccagcaaagcagctataaaaatcagaatggtgctcatgctttccccatcttactaagtctgtcaggcgtggtcagtcgcaccctgtccaataaacatttttctgtggttggctatcggcaagcgtggagttgaacttgagcattgtaaagcgcatcccagtgaaggcaaatcatagcaataccaccaaaaacggaatatcagcaaattcctggagttatttcaacctattgacttttaatttgaaataagaattaatttttattacgttacataaatgtaaataaacggcaattcgcattgccgaaaccgtgcggtatgtcgcacaatgaccacagattacactgcaaagattctcacaatgagcaaatcattacaaaaacccaccattctgaaagtggaaaccgtcgcacaatcccgactgtttaacgtagaaagcgtggatctggagttcagcaacggcgtgcgtcgcgtgtatgaacgtatgcgaccatcaacccgtgaggcggtaatgattgtgccgatcgttgatgagcatctgattcttattcgtgagtatgcggtgggaaccgaatcctatgagctgggcttctcgaaaggattgatcgacccgggcgagaccgtttttgaagcggcgaaccgggagctcaaagaagaggtcgggtttggcgcgcataacctgaccttcttaaaaaaactcagcatggcgccctcttatttttccagcaaaatgaatatcgtggtggcggaagatctctatccggagtcgctggaaggcgacgagcctgagccattgccgcaggtacgctggccgctggcgcatttaatggatctgctggaagaccccgattttaacgaggcccgcaacgtcagcgcgctgtttctggtacgcgagtggttgaaagcgcagggccgaattgcctgatggcgcggcgttgatcaagccaacggaaagtttgtctccccgttcgccgtcatccgctaaacacaataaaaaaggcgccggagcgccttttttgatcagaacagttcgtgtgtttcaccattatcaataatggtggttcccacctcgtgtaccgcctgttgtgtcggctgcgtgccttcgatgaaatactcttcacggctgttaccgccgctcgccagttgtccggtactgcggtcgatattcaccgtgacgatgcccggcggcggcgttagcggctgtttcggcacgccttccagcacggctttcatataggcgtcccatgcaggttgcgcgctcttcgcgccgccctcatagccggagatttgatctttgatcgcgccggaagcggtggtgcggcctaaatcacggcggtgatcgtcaaagccgatccatacggaagtgacgacgccaggaccatagccggagaaccatgcgtctttcgagctgttggtcgtaccggttttgccgccgatatcgcgacgtttaaggtcgcgcgccgcacgccagccggtacccatccagccgggttcgccgaagatattggtgttcagcgcgcttttgatcagaaacgccagcggcgtattgatcacatgcggcgcgtactcctgcgtgccgttttgcgcgaccagcgcctggtttgcctgttccagctcaggcatcggtacggcgctgttttgctgctcttgcgaaaccgcgacctcttccacattggtgttttccagcacgtcggatttctgcgtattgccgtaaatgaccgggatatcgcactccgtgcaggcgattttcggtttcgcttcgaagatcacgccgccctgatcgttctcaatcttgctgatgaaatacgggtcgatcaggaaaccgccgttcgccatcaccgcataaccgcgcgcaacctgcatcggcgtgaaggaggtggagcccagcgccagcgattcggtatgcacgatattctgcgccgggaagccgaagcgttgcagatactccgccgcatagtcgacgcccatggcgcgcatggcgcgtaccatcaccacgtttttcgactgccccagcccctggcgtaaacgaatcggtccggcgtactgcggcggagagtttttcggacgccagtctgaaccggccccggcgtcccagcgggaaatcggcacatcgttgagcatactggcgagcgtcaggcctttatccattgcggcggtgtagaggaacggtttgatgttcgaccccacctgacgcaaagcttgcgtcgcgcggttaaatttactctgattaaaatcgaaaccgccgaccagcgccagtaccgcgccagtttgcgggttaagcgaaaccagcgcggagttcacttccggtacctgcgccagccaccagtcgttatccacctgacgaacccagatttgctgacctgtctggacgacatcggtaactttacgcggcgtcggcccctgctgtgtatccgagcggtaaggccgcgcccaacgcattccttccatatgtagcgaaacggacgtaccgtcggcaagcgcagcggtcgcctcttgcggattagcgctggtgaccacggcgggaagcagcggtccgtaggtcggcaacgctttcaacgtatcggtaatttttttactgtcccacgccgtttcgcccactttccatagcacattcgccgggccgctataaccgtggcgcatgtcatagtccagcacgttattacgcaccgcctgttgcgcggcctgctgcactttgcgggtgatggtcgtgtaaatacgataaccatcttcataggcgctttcgccataacggttatacatttcctggcgcaccatttccgacagataaggcgcggagaaggcgatttccggcgcgtgataatttgcgtcgataggttcgctacgggcctgatcgtactgcgcctgagtgatatatccctcgcttaacattcgtgagagcactacgttacggcgcgccaccgcccgatccatcgagtagagcgggttaaaggtagaaggcgctttaggtagcccggcgataaccgccatttcgcttaaactaagctggtcgaccgtcttaccaaagtagacctgtgccgccgcgccaacgccataggcgcggtagccgagatagatcttgttcagatagagttcgaggatctcatttttattcagcaactgctcaatacgaatcgccagaaacgcttccttgatcttgcgcatcagcgtgcgttcggggctaaggaagaagtttcgcgccagttgctgggtaatggtacttgctccctgcgatgcgtgaccggagaagagcgcgacgctggccgcacggaaaatacctaccgggtcaataccgtgatgctcataaaagcggctatcttcggtggcgataaaggcgttgatcatttccggcggaatttgatcgagcgtaacgggaatacggcgtttttcgccatattgcgcgataagttcgccatccgcgctgtaaacctgcatcggaatttgtaaacgcacatctttcaatgtcgcgacgtcaggtagctgcggctcaatatagcgataaaggtcataaatcgagcctgctcccagcaggatgcaacatactgcaaggatcaataaatactttacgaacttcactggagatttcccatttagtgtcatttgggcagtttataaacaaacgcgcggtagtataaaggcaagccagacgcattgatatacccgttaacgcgacgggtgataaggagatcgaccgttatggcttttaaaacctggcaaataggattgcatattcagcagcatgaagcgctggccatcgccgttattcgcggcgcatcgggctggtccctgcaacgttggtggcgactgccgctgatgaacgcctccacggcagagggtacgattcctgacccgcaatcgctggctcacgtactgcgaccctggagccgcgagctgccgctacgtcaccgtatttatctctcttttcccgcaaatcggacattgcaacgcgcttttccacatccgccgatgcgtctgcgggaacgtgagcaagtcgcatggctttcacaaacgatggcgcgtgagctggatatggatccggacttattgcgtttcgactttcaggacgatgcgctgagccccgcgttcaacgttaccgccgtgcaaagcaaagaaatttcagagctgttaacgctggcgcaaacgctcaatgtacgcatcgctgctgtaacgcccgatgcctgcgcgttacagcgcttgctgccgtttataccttcggggcggcaatgtctggtctggcgcgatgaaagccagtggctgtgggcgacgcgctatgcgtgggggcgtaaatcggcgcgagaggcgatgacgctgcatgaccttgccgcgacgttatccgtcgtgccggaacatatttcgttatgcgccgaaggcgaattcgacccctggcgcgccgttaccgtccgccaaccgccggttccgccggacggttatcgctttgcgattgcgctgggtttagccatgggggagatacgctgatggcgcattctgtcaatttgcttccctggcggcgccaacattatgtagcgcgtctgcggctgtggtgcgtggtatggggcgcgtccctgctgctgatagcaagcctcgcgacgatcgcccggttggttttttggcaggaggggaggattaatgaactgctactgacggcggaaaacggacgcacgacggcgcttgcggcgaacataccgcagttgcagcagcgtcagcgacagcaacaggcgcgattacaacgtcaggcgcagcgtgaactgacgcaagcctggcaatctatcttgactgaccttgccaacctgttgccagagcaggcatggctgacaagcctcaattatcagcaagagacgctagagctggaagggctggcgagaacgtttgacgccctgctcacgcttgagacatcacttcgtcactatgtcagttttccgctaaaccgcacgggcgccacgcggcaggatgcgcaagggcgctggcagttccattatcagttaacgaggagcgccgcccgtgaacgcgctctttgatatctggtacgggatgtcgcgccgtggtcgggttttttgttggtgtgcaggcgtgctgtgcctgacgctgacggtcgcgttatctgtgggctatcccggctggaagacgctggatacgcaacatgcgcggttaagccagcagcgcgaggccgcccggcaacagtggcgtcatctgcgccgtctgagcgtcgcggctgaaccgcttttcgggcgtaccatcgaaaatccgcgtcctttttcgccgttagatttccaggcgcctcccttgcgtttgctgcactggcagccatcggcgcaggggggagaaatggcgctgaaaacgtcctgggatgcggtgccgtcgctgtttgtccggttggccgaaagcgagatgagcgtaagtcggttttcattgcgtagggagggggcggaattattgataacgctgcaactggagcgactggcgaatgaaggttagccgcggtgtattgctctgtttttgtttgctgacgttgacgggaatgcgcgatcccttccgcccgccggaagatcgctgccggatagcggaactctcgcagtggcgatatcagggcgcggtgcgtaaaggcgagcgatggacaggcattcttaaagacagccagcaaaaatggcggcgagtggaagaagggcagacgctggaaaacggttggacgattgtccgcctgacggcggaagccttaacgttaacgaccggtaaaaattgtgcgccgccgcagtggcggtggttacgtcagggagcggacaatgaagcgatggatagccataatactgatagtcttgatgcccgccgcgcaggcgggaaaagcggcgaaagtgacgctggtggttgatgacgttcctgtggtgcaggttttgcaggctttagccgaacaggagcggcagaatctggtggtgtcgccggacgtcagcgggacattatcgctacatctgacggatgtgccgtggaaacaggcgcttcagacggtggtcaatagcgcggggctggtgctgcgtcaggaggggaatattctccatgttcattcacaggcctggcagaaagaacacagtgcgcggcaggatgccgagcggttaaggcttcaggctaatttaccgctggaaaaccgcagcattagcctgcaatacgccgatgccggcgaactggcgaaagcgggcgagaaactcctgagcgcgaagggaaccatcatggtagataagcgcaccaaccgcctgctgttgcgcgataaccgcgcggccctggcggagctggaaaaatgggtatcgcaaatggatctgccggtggcgcaggtggagctggcggcgcatatcgtcaccattaacgaaaagagtctacgggaactgggcgtaaagtggacgctggctgacgcgacgcaagcgggcgcggtgggtgacgtgacgacgctttccagtgatttatccgtcgccgccgccacctcacgcgtcgggtttaacatcgggcgcattaacggacgcctgctggatttagagctgtcagcgctggaacaaaagcagcagttggatattatcgccagcccccggctgctggcttcgcatctacagccagccagtatcaagcaaggcagcgaaattccttatcaggtttccagcggcgaaagcggcgcgacctccgtggaatttaaagaagcggtactgggaatggaggtgacgcccaccgttttgcaaaaagggcgcatccgcctgaagttacatatcagccagaatgttcccggtcaggtactacaacaggctgacggcgaagtgctggcgatagataaacaggaaattgaaacgcaggtagaggtaaaaagcggcgagacgctggcgctgggcggcattttttcgcgaaaaaataaatcgggtagcgatagcgtgccgctgttgggggatattccctggcttggtcagctcttccgccatgacggcaaagaggacgagcgacgcgaattagtggtgtttatcacccccagactggtggcgacagaataatttatgcataaaaaagcgctgtttttgcactgaacgcatctgcgggatttgacgtgcggatgtatttagcatacaaggagtaccgatttgagagtcgtgcttttcgttgcttacgcattgattaatgcgctttgccttgccgaaggtgtgcataagaccgatgataaacggctgaatgtccgctgatgcagacgtattggttctgcggattgcgcacaattgtttgaaagtagagcaatttgtaggccggatatgttgttctggtcgccatttggcaacgctaactcgggttttgcaacaatcaggcttggtgatttattcagttgccaaacccgcttgagtattgagataattttcagtctgactctcgcaatatcttatgaggtttcagttcatgtcctgctgcgctgggtgtctgtgaagcgggtttaccattaacgaatagtcttagtagtaccgaaaaaatggcagagaaacgcaatatctttctggttgggcctatgggtgccggaaaaagcactattgggcgccagttagctcaacaactcaatatggaattttacgattctgatcaagagattgagaaacgaaccggagctgatgtgggctgggtcttcgatgttgaaggtgaagacggcttccgtaatcgtgaagaaaaagttatcaacgaattgacggaaaaacagggtattgtgctggcaaccggcggtggctctgtaaaatcgcgtgaaacgcgtaaccgtctctccgcgcgtggcgtcgtggtctaccttgaaacgaccatcgaaaaacaactggcgcgcacgcagcgtgataaaaaacgcccgctgttgcaggttgaagcaccgcctcgcgaagttctggaagcgctggctaacgaacgcaatccgctgtacgaagagattgccgacgtcaccattcgcaccgacgatcaaagcgctaaggttgtggcaaaccagattattcatatgctggaaagcaactaattcaagcagaatacgctgggtaagcgggcacaagtaactaaggtggatgtcgcgtcatggagaggattacagtcactctcggggaacgtagttacccgatcaccatcgcggctggtttgtttaacgaaccagcttcattcttgccgctgaaatcaggcgatcaggtcatgttagtgaccaacgaaaccctggcgccgctttatctggacaaggttcgcggcgtactcgaacgggcgggcgttaacgtagacagcgtgattcttcctgacggcgagcagtataagagcctgacggtgctggatacggtgtttacggcgttactgaaaaaaccgcatggtcgtgataccacgctggtcgcgcttggcggcggcgtgattggcgatcttaccggttttgcggcggccagctaccagcgaggcgttcgtttcatccaggtgccaactaccttactgtcgcaggttgattcttccgtgggcgggaagaccgccgtcaaccatccccttggcaaaaacatgattggcgcgttttaccaacccgcttctgtggttgtcgatcttgattgcctgaaaacgcttcccgcacgcgaactggcatcgggactggcagaggtgatcaaatacggcattatactcgacgcagacttcttcacctggcttgagggtaatctggatgcgctattgcgtctggacggcccggcgatggcgtactgtattcgtcgttgttgcgagctgaaagccgaagttgttgccgccgacgagcgtgaagcgggcttacgtgctttactgaatcttgggcatacctttggccacgccattgaagcggaaatgggatatggcaattggttacatggtgaagccgttgccgcaggtatagtgatggctgcgcgcgcatccgagcgtttggggcagttcagttctgctgatacgcagcgcatcatcgcgctactcgaacgggccgggttgccagtcaatggcccttgcgagatgtccgcgcaggactatttgccgcacatgctgcgagataaaaaagtgttagcgggggagctgcgtttagtgcttccgctgaccatagggaaaagtgaagtgcgcggcggagtgtcgcacgaagtcgttcttagcgcgattgctgactgtcagcaggcgtaacaacaagaaaggtcagactgatattgcgtagctgtcagtcttttagcttcaggttatgtgcaatgtcgtaagcattaacctttgagtggggtgttaaatggatgaattcaaaccagaagacgagctgaaacccgatcccagcgatcgtcgtactggtcgttctcgtcaatcttcagaacgcgataatgagccgcagatcaactttgatgacgttgatctggatgccgacgatcgccgtccgacgcgtacgcgtaaagcgcgtagtgaagaacctgaagttgaagaagagtacgaatccgatgaagacgatacggtggacgaagagcgtgttgaacgccgtccacgtaagcgtaaaaaagcggcccataagccagcctctcgtcagtacatgatgatgggcgttggcgtactggtgctgctgctgttgattatcggtatcggctccgcgctgaaagccccctcaacgtcttccagcgagccgtcggcctctggcgaaaagagtatcgatctttccggtaacgccgccgatcaggcgaatgcgacccagcctgcgccgggcgccacctccgcagaacaaaccgcgggcaatacgtcgcaggatatttcgttgccgccgatttcttcaacgccgatgcagggacagtcgcctgtggtcgctgacggtcagcagcgcgtggaagtgcagggcgatctgaataatgcgctgacgcagaatccagagcagatgaacaatgttgcggtgaactctacgttgccgacagagcctgcaaccgtcgcgccagttcgcaatggcagcacgacgcgtcaggcggcggttagcgaacctgccgagcgtcataccacgcgtccggaacgtaaacaggccgtcattgaacttaagaaaccgcagaccacggcgaaaaccaccactgcggaaccgaagaaaccggtcgcgccagtgaaacgcacggaaccggcagcgccagccgcgacgccgaaagcgaccaccacgacggctgcgccgcaagcgacggcaagcgctgcgccggtacaaaccgcgaagccggcgcaagcctcgacgacgcctgtcgcaggcggcgggaaaagcgccggcaacgttggcgcattaaagagcgcgccatccagccactacacattgcagctcagtagttcttcaaattacgacaacctgaacggttgggcgaagaaagagaacctgaaaaattatgtggtatacgagacgacgcgtaatggacaaccgtggtatgtgctggtaacggggatgtatgcttcgaaagaagatgctaaacgtgcggtgtccaccttacctgccgatgtgcaggcgaaaaacccgtgggcaaaaccgttgcatcaggttcaggccgatctgaaataatccaggctgtgtcctgcaattgcctgtgagtgtcgctgacagctattttttttcaggacaggcgcgaggggcgcatttgctaccgtcaaatgcgccgtaaagcaacgcggcacagcctaaagcgcaggatgctgtcggagctttctccacagccggagaaggtgtaattagttagtcagcatgaaaaaaaatcgcgcttttttgaagtgggcagggggaaaataccctctgcttgatgatatcaaacgacatttgccaaaaggcgagtgccttgtcgaaccttttgtgagtgccggatcggtgtttcttaacaccgacttttctcgttatatcctcgccgatatcaacagcgaccttattagcctctataacatcgtgaagttacgtactgacgagtatgtacaggcttcgcgcgagctgtttatgcctgaaactaaccaggctgaggtctattaccaactccgtgaggagttcaacacctgccaggacccctttcgtcgggcggtactgtttttatatctgaaccgctacggttataacggactctgccgctataacttgcgcggggaatttaatgtaccgtttggtcgttataaaagaccttacttcccggaagcggagttgtaccactttgcagaaaaagcgcagaatgcgttcttttactgtgagtcatacgcagacagtatggcgcgtgcggacaagtcgtcggtggtctattgcgatccgccttatgcgccgttgtccgccacggctaacttcacagcgtatcacaccaatagttttagcctgacgcaacaagcgcatctggcggaaatcgctgagaatctggtcagtaaccggataccggtgctcatttccaaccatgatacggcgctcacacgcgagtggtatcaactcgcaaaattgcatgtcgtcaaagttagacgcagtataagcagcaacggcggcacacgtaaaaaggtggacgaactgctggctctgtaccaaccaggagtcgcaacgcctgcaagaaaataattctcaaggagaagcggatgaaacagtatttgattgccccctcaattctgtcggctgattttgctcgcctgggtgaagacaccgccaaagcgctggctgccggtgctgatgttgtacactttgacgtcatggataatcactatgtgccgaacctgactatcggcccgatggtgctgaaatccctgcgtcagtacggtattaccgcgcctattgatgtccacctgatggtcaagccggttgaccgtatcgtgcccgactttgccgccgctggcgcgagcatcattacctttcacccggaagcctccgaacatgttgaccgcacgctacagctgattaaagagcacggctgtaaagcggggctggtattcaacccggcaacgtcgctcagttatctcgattacgtcatggacaaactggatgtgatcctgctgatgtccgtgaacccaggcttcggcggccagtcttttattccgcagacgctggataaactgcgcgaagtgcgtcgccgcattgatgcgtccggttacgacattcgcctggaagtggacggcggcgtgaaggtgaacaatatcggcgagatcgccgcagctggtgcggacatgtttgttgcggggtcggcaattttcgataaacccgactacaaaaaagtgattgatgaaatgcgcagtgagctggcaaaggtaagtcatgaataagttgcagaatattcggggcgtcgcctttgatcttgacggtacgctggtggatagcgcgccgggtcttgccgcggcggtggatatggcgctgtatgcgctggaactgccggtcgcgggcgaggagcgcgtgattacctggattggtaacggcgcagacgtattgatggaacgcgcgctgacctgggctagccaagagcgcgccacgctgcgtaagactatggggaaaccgcccgttgatgaagatattcctgccgaggaacaggtacgcattctgcgtaaactgttcgacaggtattatggcgaagtggcggaagagggcacctttttatttccgcatgtcgccgacacgctgggcgcgctgcacgccagcggattgtcattaggtctggtgacgaataagccgacgccgttcgtcgcgccgttgctggaatcgcttgatatcgccaaatactttagcgtggttatcggcggcgatgatgtgcaaaataagaagccgcatccagagccgttgttgctggtggcaagccgactgggcatgacgccggagcagatgctttttgtcggcgattcgcgtaatgatattcaggccgcaaaagcggcgggctgcccttcggttggcctgacatacggctacaattatggcgaagtgatcgcccttagcgagccggacgtcatttatgacagttttaacgatcttttgcccgcacttgggcttccgcatagcgataaccaggaaataaaaaatgactaagcccatcgtttttagtggcgcacagccctcaggtgaattgaccattggcaactatatgggggcattgcgtcagtgggtaaacatgcaggatgactatcattgcatctactgcatcgtagaccaacatgctattaccgtacgtcaggacgcgcagcagctacgtaaagcgacgctggatacgctggcgctgtacttggcatgtggtattgatcctgaaaagagcactattttcgttcagtcccatgtgccggaacatgcgcagcttggctgggcgctgaactgctatacctatttcggcgagctgagccgtatgacgcagtttaaagataaatctgcgcgctatgcggaaaatattaacgccggcctgtttgattacccggtgctgatggcggcagacatcctgctgtaccaaaccaatctggtgccggtaggcgaagatcagaagcagcatctggaactgagccgcgatatcgcccagcgtttcaacgggctgtatggcgatattttcaaagtaccggaaccgtttattccaaaatccggtgcgcgcgtgatgtcgttgctggagccgacgaagaaaatgtccaaatcggacgataaccgtaataacgtaatcggcctgttggaagatccgaaatcggtagtgaagaaaatcaaacgagcggtcactgactccgacgagccgccggtagtgcgttatgatgtgaaagagaaagcgggtgtctctaacctgctggatatcctttccgccgtgaccggtcagagcattcctgagctggaaaaacagtttgaaggtaaaatgtatggccatttgaaaggcgaagtggcggaggcggtttccggaatgctgtctgagttgcaggagcgctatcaccgtttccgcaacgacgaagcgttcttgcagaaggtgatgaaagacggggcggaaaaagccagcgcacgtgcggccgaaacgctgaaagccgtttacgaagccattggctttgtggcgaaaccgtaacggtaattgcttgcccgatggcgctagcttatcgggcctaccaacgaacgtaagttggacaaggcacctgtgccatactgtttatcagacctgtaaaaaaaccgggaaatcccggtttttttgtatctgcgcagtcgtttctattattgatcggcagccgggccgcaaccgccaataattttagaaatagaaattgcagggtgcagcaaataatcgtagctgcagttattttttttgttttcgatatgaccagtacaggcggtaagcgtcgccagaacccctgccacaacggcaatttttacaaatttaaacatgtcaaaatccttgttgataaaacgaatactactggtggaataaatataagatctatttagcgtatagtacgatagcaattaataaacaatgcaggtagtccaaataaggactttatctttaccagggaatatgatttaaaaaaggccgcttaataataagcggcctatattagtgttatataatgtcgtttatttaacgaaatgttttcttaacgttaagcataaagcctttatcgctgataccgtcttccttccactggtatgcatccagatgtagcgcggtatcattgctgctatatttcacgccgatggttgccaggccattaatgccgccgcctttttgaccgtcatccacgccgaacgattgacccgccgcaccctgtaatgacgctgtacgctggctcttgctgtagctcaggttcgggccgccttccagggtagcggtggcgctccagccgtctttcccggcgtaatccagcttcatacccacaatggaatccaccgctgtttcgctgccagagttcatcgacaggttaaaatcgccagcgttgcgctctttgtagccatcttccatggtatgacggaatttcaccccggcatacggcgtcactttcagcgcatcgtccatcagggagaaggttttcgccccctcgctacggaactccatgtactgctgacgcgcatcggaatcggcaattttgttaacatcgccataggcgacagaacggctgctgtcgaggttgtgtacgtcataacgcaggctgttattccacgccagaccttcatcaaacgccatgctgtgcttcagaccaaagaactggctgtagccgccggtcaggccgttgtcgcccgctttttgcgaaccatcgccgtccagacgggcgataccgtattccagcgtcaggttctggtttgcggttaagtccagtttctgacgcagcgccagcatgtcgtactgggtgtcgttgcccagctcggcgcgcgggtcgcctttcgccaccacgttaaacgccaggccgtctttaatctgcggcgcggcgtcggccagcatgttgaagcggttgcttaacacccgggcttcacggaataccgtagtggcctggctgccgcttacctgtttcagcgcactgttgagttcggcggtggtgcctacgttaaggctggtgtacagctcgttgttggtgtagccagcgtccagcgcctgcgccacgtcagacacgctaccgtcggttgccacatcggcgtaggcgtttttggtcatggtgacgtcaacgttgccgtcgctgtcctgactgccctgggcgttccacaccacgctggtggactggatagcggaagcgtcggtgaggttgctgccctccaccacgttgtcaaagctgacggtggtgtcggcggtgcctgcggtgaagccggtattgatacccacgccttccatgctggcgttgctgaccttaagctggcctgcgctgccgtcggcgttcgtgccaaccacgtagccgttcaggttgttggacgcgccggacgtgtcgccggcggcgaagccggaggtcgtgttgctgccgggttcaacaggcgtttccggcaacgtatagtcggcataatgcgcctcgtcgctgttgccgttattaccgtttgtcccttcgacgttaacgctgtcaccctgtttaataataccggaacccgttacgccatcggcaatgactaccgtcccgttattaaccacatgccccgcacccgccacgctaaacgcgtaagagttattggcgtaaatattaattgtaccgttgttctcaatgacagcattagcggtagcatttttatccagcgccatcgcgaccatgcctgtgtcggtggtgccttctgtacctaaattgatcgtattgttattgaccagttgtgcatttttgccgccatacatgccgtaagcgttattaccgctgatattcatggtgccgtcgttgaccgctacgtaattgttataggcggagaaatcgacggcgcggccattatccgcatcgtaattgattacgccgtttgactggttccagaagaaagcgtgtttatccggggcattacctgcgccgccccccgcataagcaagcaccgcagtagtggcatttaccgtaccgtcattgataaatgccgctcccgcgccccaatagttaatcgcgcccttattggaggttgccgtaagctccatcgtcccggtgttgtacagcgttccgttattcgcattcaggtgaatggcatttttgttgttatcaaggattaacgtaccggtattaaagaattgcgcgaaatcattgatttccagcatggacgcatttttagcgtcagtcgcggagccaagatagaacgtaccgtcgttaatgattgcactgttagcgccagtcacttttgcgccggaagccatggtgccatccgtgcgttagttaatacgccgttggtcgtcaggctacggctgtcaatggtgccattattaacgatatcgccgccattttgcgtcagcgcaccgtttatgacgccgtcattgacaaggttgccggataccgtggtgttgctattgataacgccgctgtcgttgttggtcagcgtgccgctatccaggacggtaatggactcgccgctgaccactccggtattattaacgtctcctgtcacaatcgctttattaccaagcgttgtacttgttccggcatcggcaatcgtagcgccgtctgtgtaagggatagaaacgtcactgtttgttggattgtactcgtcgctgtcctggcaatcgtcgccaaaacagacggtgccgtagttaacaatcaggctattgccgtcggtcaggaaaggcttgccgtaatcggcataaatattgattttgcctgtggtatcgttgacaacggttccgccgttgagcgccgccatgcctaccagttgattcgggtcggtcccttcaacgcccgcatcagcggtcagattaattaccccctggttaatggcggtaccgccgttaagcgccatcatgccgaacccggcgttattgacgttaatggtgccggtgttggtggcggtggcatcgccataaccgctgtcggtggtgcctgcgaccatcgcggcgctggtgacataaagtttcggtggcgtccagtaagttttgtcggtgatgttattttcatcatccagcgtcgggacaaagccgtccaggtagatatcaccagcgttgagcgccgtgcctttgctggcggatacgccgtatacccctgcgccctgcaaatatatggtggcgccggcgtcgttactcacctcgccgtagtcctctgccagcatggcgtacagggtatttttgtaccagattagtgggaagttgcccgcgccggtatttgaaaacggagttaatgatgaaactaaggtgattgtcccttccgcttcattattaacggtggaaccctggccgttagccgcggctatcgcattacggctggacgtccctgttgtggcatacgcggtaatcttgccgctgttttgtgcctgtgcgccgctatccgccagtaataaagcgacggcgccatcgtcaacgacagtgccctgattattgattgaggagccctcgccgctggcggttaacagggcctgcgtcatgtaataattagaaagaataaccgtttcattgatattaaccgttgagttttgatctaacgttaagttgccgccatttctcacattcgccagcgtcaccgcgccgccggggacggtggcaatattgagcgtggattcaccgcttagcgttacgctactgtctccgctgatgtttatactggtaacggctgattcgaggccgtcagcatcttcggtgtagttgatattaataccgccggctaagtccacggtattgccatcacctgccacatcaaggccaacggtattcagatattgttcgtccacgttactcatatcgctgacgttaatattgagcgtgccgctcaggtccaccgcattattgctgccgctgatagacatccccataagggtatcgctgctgccggccatcacgctgtctttgtcatagtcgccgttgaccgtgacgctgccgataatattcagcgtgttgttattccccgtcatgtcgaggcccgtcgcgccacgataaacgttatccccgtcctctgttgcggtgacattaatatcgccatccagcgtcgcttgcgacgcattgccgcttaccagcgcgccggtgccgttaaggctgatgttaatattccccttgtttttgaaggtgttttgttcgcctgcgaccacaaaccccactgagtctacatcacgcacggtggcgttgccggtatttttggcttcatttccggcgccgtaggtgatgatgcccatcgcgccgtcggtgaccagcagatcgcccgcctgggtcaggctgctattgtcgccattaataatcgccgccgcagagcctgcgccatcaacggcgatatcgccggtattggcgatacgggcgtcgtcgccgtcaattcgcgtaccaatggcgccgccggaaatagtctgattaccttcattgataatgagcgcattgtcgccgtcgatatacagcgccgttgagcccgtgccgctgacggtggtgtccccggcgttatcgataaccgcgttatcgccggtgatgtgagcaccggtgccgccatcggtgatggtcatatcaccgtcattgttgacgcgggcgttattgccgtcaatgacggtgccggtggagcctgtgccgttgatggtggaggtaccagtattcttaatcgtggcgttgtcgccgtcgatgatgatggcggtgccgccgccgctcacggcaatgtcaccggcgaaattggtggtggttccgttgccggaaatcagcgcgccggtggcgttgtccaccgttgagtggcccgaaatggtgttggtggtgccatcgccagtgatcaccatgccgatggcgccgtcggtcacactggaacccccggtgagcgtgttgacggttcgattgccggaaataatcacgccggtgcgatcctggccgctgatatccatgccgcgatcggaggtatgcgattcgccgtcgccgctgataacggtggttttatcgtcggcaaggatcagatagccccggctgtcatacttccagtagagaccattttcctgggtgccttcaatcacggcggcattagcgtcggtcacgtcccaaccggtgacgttcagcgttttgccgcccaggggggtgagctgccactggttgttctgttctgaataattccacacggcaccctcgagaacgctgccgctatccagtttgaagctatcgaaggccagggtgtctttgcctttatcgatggtgacgccgttgctgaaggttataacagagtcatccgggggcgtgtcgtcgtcatcgggcggggtcacatcgtcatcgccgctatcgtcgggcggggttacatcgtcatcgccgctatcgtcgggcggggtgacattgccgccatcgtcgggcgtagggggaatataagaatgagtagaatctccgccaccgttattttcaacgccaataaccacacccgcgaccaatgcggcaacgccgccagcaacccagccccagtgattatcattttcaggtaatgtagcaaggcaggtcggtgagagttttgcgcgtttttctttaggcagggaggcgatattactgggacattctttttcatcatcgttattctctgcggcgatggccggaatgtaataactttgcagcgttaaagcgatagcgatagaaataagttttttcttttgcatagagttcatccttaattaatatttccttgcgtactaaacatatgcggatagcgatacaggcaatgatgaaatggccagaagaaaattatgatttagtgtttattttatcacccgataaccaggtcaggtcaaattgaaggcttaacgatattatttattgggtgaatgaataacgggtgaatttgacgaatgaaagggtttttacgcaatataattgctatttaaattcgtttggtgtatttaaaatggattgcttaattcaattttaagtaaaaataattttagattacgagtagttgtaaaataaagccctgaataacagggctttattttaattaatgattagagaaccaatttaatttatcgcgtaaggctaccacgcgaccaacgataatcagcgccgggctttcaacctgttgcgctaattcaccaagctgcgtcagcacaccgtgaacgacgcgttgctttacggaggtaccgttttccaccagcgcaaccggcatattggcctccataccgaatgcgatcagtttttcctggatagtcgctgcctgattcagccccatgtagaacaccagcgtctgtttttctgccgccaggttttcccagtccagctcgccgccggttttcaggtgacccgtgaccagacgtacgctctgtgcgtaatcgcgatgggttagcggaataccggagtaggcggagcagccggaagccgcggtaatccccggtactactgagaaaggaataccggcatgacacagcgtttccagctcttcgccgccgcgaccaaagataaagggatcgccgcctttcaggcgtaccacgcgtttacctttttgcgcttcacgcagcaggatctggttgatttcctcctgtgggacgcagtggtaacccgcgcgtttccccacaaagacccgatcggcatcgcggcgtaccaggttcataatgtcgtcggaaacgaggcgatcgtaaaccacgatatccgcctgttggatttgttgtaatcctttcagcgtaagcagcccggcatcgcccggcccggcgccgaccagcacgacttcgccacggtgatccagcggctcgctaaacaggtgttcagttgtcgcgttaaccgctttctcatcggcattcgccagcgactgcgccagccggtcattgacgaaaaatttttcccagaagcgacgacgttcgcccatggtggcaaactgctttttcactcgggcgcggagctgtccggcatagcgcgcgacctgccccagatgctgcggcagcagcgattccagtttctcgcgcagcagacgcgccagcaccggggaggtgccgccggaggagacggcgaccatcagcggcgagcggtcgataatggagggcatgataaagctggcggctttcggcgcatccaccacgttgcagaagatacggcgtgattccgccgcttcgctgacgcgctggttgacggtatcgtcgtcagtggccgcgatcgccagccaacacgagtcgagaagcgtttcgtcgaacggcccctcaaccagagtcaacatgccttcatttacccatacggtgaactgcggaataaatgttagcgcattgaccgttaaacgtgcgcctgcttccagcagtaaccgtgctttgcgttctgcgacatcgccaccgccgacgatcagacagtcgcggtcgcgcaattgacaaaatataggcaaatggtccacgacattaccccttaatggttggctgtagccttaatttggttggttttttgcggaacagggcgctccgatttcggcgtagcataccaataacccaatcccatgaacacgacgccggacaaagtattgcccagagtgacccataacagattgtgtccgattccggacagggtataggcatcgctgtgatggccaaaccaggagagggcgaacagcgtcatattcgcgacggagtgctcgtagccggaagcgataaacgccagcagacaccaccagatagcaagaaattttgccgtgccttcggtgcggatcgccatccagattgccagacaaaccagccagttacacagcgcgcctttgaagaacagtaccgtggcgggcgcggtggttttcgccagcgcgactgagtgaacgatactggtatcgaccggcaacaaactgccgccgccccagctgtaaagcagggcgacaaacacggaaccaaccaggttgccgagccaggtttgcggcaggatagcccacatttgaccgtggctgatggtgcccgctttgacgcccagcgtcaggaacatggtgtggccggtaaacagttcggaaccggcgatgatgaccagcgttaaggcgataccgaaggtggctcccatcaccaaaggacgcacggacgggtcgagcagattgccgagggtgaaaataagaatgatgccgagaccgacataagccccggccattgccgaactgacccagaagccgagcggattattcgccgacaggcgtgcgatgcgcgcagcgttagccgcacacttattaatagtgtctgtaaacatttgattatccttgaagtataaaaaacaaaaaaatcgtaaccgtaggccggataaggcgtttatgccgccatccggcaatgtgcttttgcaattgcctgatggcgctacgcttatcaggcctaccaataaaagacctacaaatacgtcaaaaaaggggaggcgttgcgcctcccaaaaataattaaccgcgcaactgcaccacgccgtcttttacccgcgcgtcgtaatgcttcacagagaactgctcatcttccatgcacagcccgtcgcttaaacgaaagcgctgctttttcaacgggctggcgacccacagttcgccctggtgttccgcaatcagcccacgagacagcacactggcctcaaagaacgggtcgatgttgctgatcgcaaacacctgatcgctatggtaaggacggaaaatcgccacctgctcgccgcctgacagcgcgcagacgccggttcccggcaggatgtcatcaattttgcagatgttttgccactggctcatgcgttttcctccaccagagtgaccgggatgcgttcatacggcgtggccggacgatgctgttcgcgttcaggcacaacctggacatttgggtcgcgtttgtcgctgttgatgaagtgtttgaaacgaacctgcgccgctggcgtgttgacggtctccgtccactcgcagaccaccgctgcgcgcaggcgcgccatctcttcttccagatgttcgttcaggcccagcttatcgtcgataatgaccgacttcagatattcgatgccgccttccaggttatccagccacggcgcggtacgcgtcagcttatcggcggtacggatgtagaacatcataaagcggtcgaggtacttgatcagcgtgtcgcgatcgagatcggctgccagcagatccgcatgacgcggtttcatcccgccgttaccgcaaacgtacaggttccagcctttctcagtggcgatgataccgacatctttaccctgtgcttccgcacattcacgggtacagccggagacgccgaatttcattttgtgcggggtacgaatgcctttgtagcggttttccagctccacgccgaaaccgacgctgtcgcccacgccgtagcggcaccaggtgctgccgacgcaggttttcgccatccgcagcgctttggcgtacgcgtgaccggtttcgaaaccggcttcaatcaactgacgccagatttccggcagatcgtctttttgcgcgccgaacagaccgatacgctgagaaccggtgattttggtatagaggttaaactcgcgggcgatacgacccacggccaccagaccttccggcgtgatttcaccacccgccgagcgcgggatcaccgagtaggtgccgtctttctgaatattcgctaggaagttatcgttagtatcctgtagcggcgtgtgctgcggtttgaggatgtattcgttccagcacgacgccagcagcgaaccgacggttggcttacacacttcgcagccgtagcctttaccgtgtttcgtcagcagttcttcaaaggttttgataccttccacgcggattaagtggaacagttcctgacgagaataagcaaagtgctcgcacaggttgttgttgacttcaataccctgtttcgccagttcggcgttcagtacctgcgtcaccagcgggatgcagccgccgcagccggttccggctttggtttccgctttcagcgctgccacggtatggcagcctttattgatagcagcgatcagatcgcctttagtcacatcgaagcaggagcagatctgcgcgctgtccggcagtttatccacgccgatagcgggtttaccactgctcgcgtgcgacggcaggatcagcgaatccgggttttccggcagttcgatggcgttcagtaccagttgcagcaaattgccgtaatcgctggtgtcgccgaccagtactgcgccgagcagcgttttgttatcttcgctgacaataagacgtttgtagacttctttgctttcatcgaggtaaacgtagctacgcgcgcccggcgtgcggccatgcgcatcgccaatcccgccgacgtccacgcccagcagcttcagtttggcgctgagatccgcgccttcaaaggcgttttcactgccgaggatatggtcaacggcgacctgggccattttatagcccggtgcgaccagaccgtaaacgcggttgttccaactggcgcactcgccgatagcgtagatatccgggtcggacgtctggcaggtgtcgttaatcacgatcccgccgcgctgcgcgacggccagaccgcactgggtagccagcttgtcgcgggggcgaataccggtagagaagacgataaaatcgacttccaactcgctgccatcggcaaaacgcatagtcttacgcgcttcgttaccctgctgaacaatctcttgcgtgtttttactggtgtgtacacgcacgcccatgctttcgatcttgcgacgtagctgctcgccgcccatttgatcgagttgttccgccatcagcattggcgcaaattcaatgacgtgcgtttccacgccgaggtttttcagcgcgccagcggcttccagccccagcagaccgccgccgaccaccgccccgcgcttgctgcggcgggcgcaggcttcgatagcgttgaggtcttcaatggtacggtaaacgaagcaatcctgggtttcggagcctttaatcggcggaatccacggataggaaccggtcgccatgatcagcttgtcataataaacggtacgacccgcgctggagtgaatcactttctcctgacggttaatggtaattgcgcgttcgccaaccagtacctttacgccgtgcttctcgtaaaatccttcacgcaccagagagagctcttccgcggtgtggtgagagaagtaggatgacaggtggacacggtcataggctttacggggttcttcacagaacacggtaatgtcgaacaggctagcgtcggatttatcaaggagatcctcaataaagcggtggccgaccataccattaccgataatagcgagtctgactttgctcatttttgcctcgatttcttttctattaccgcctaccttaacgattcagcaaccccgcttattgatgtaaatcaaattcacctttatatacctcttaatgggtatatggctgatttgtctgggtttttataagtggcggaattgtcaggcttttcaggtttgtacaaataacatacaaaatgaggggtttttagaccaacaagcctacctcgtcagggggggatagagtgccggagggcgacgtcgccttatccggcctaccaacagcttacgctgtaggccggataagatgcatcgcgtcgccatccggcaatcattattaatgcgccgctggcgaactatgctggcgatgacgggagacaaagccgagcgcaaagcacatcacaaagaccaccgcatacagaccattcgcggtgagtaacgccgcctgtgggccgctgtgagccacaatcgggccggtgacgacgaaggtcagcatcgttccgatggtgccgcaggtcagaataaagttaaccagcttaggcgaggccactttcgtttgctgcgatcccagcgtaatgatggaggtataaatggcgctggagaagaagcccagcgtcagaataaaccacggcatatgcgtctgcgtgccggtaataaacagatacatcagtatcgccgccatacccgccagtacggtcaggatgcgttgcagatcgaaaaagcgcaggataaagctgaacgcccacatgccaaacatataggacatccagaaatcactcaccagcgccccggcgtcattcaggctcatgccgaggcctttggcgtattccggcacccaggagataaagcccaattgaccgaggatatagcacagcgcggcgacggccagaaacagtacgccaatgccccatttttctttgacgacaggcgcctgagagtgctgcgcatgtttacccagcgccggaaattcacagccgaaggtcaggataaaaatcgccaggtagaccaggccgatgcaggcgtagacccagtaccactcaatactacgcgccagcaggaaggcggcgaccataggaaaaatcatccccgccatgctgaagaaggagtcggtaaacagcagtcgggaaccgcgctgacgcccttcatacagttgcgtaatcaggaaggtgccaatcgacatggtgatcccgctgaccagccccagcacaaacatcgccgctgagaacaacgccaggctatggctgaacatcagcccggccaccgccagtaccatcaggataaaaccaaagcgtagctgtgttttcagcgggacgatttccatcaaccacgcattgaggaagatcgagatcaaaatcccggcattcaggaaagtaaaggtgttactcatgctggaaacgggcaactgaaaatagtctgcgatatttcccatcaccatcccggtgacaatcaccagcgccccggtcagggcgtaggaaagaaagctgatccatgtgagcttgatgcggttgctgttagtcatgtctggccttgaagagaagtgaagcgcgtggagggcgcgttaagcgggcagattttaagcgcttttgtgatgtatttaaataattattagtgatagtaatgttcattacattttttaatgtgatgtttgtcacatcatattgcaaggacaaggcgttgcgtcgtaacgttacatttgtttcatgtacgtaaaattaggtaaagggctggcctggcccaggaaggctctttagaatcattccacttgctttatttctgctctctttaaggaaatctcatgctcaaatcgactctggcggctgtcgcagctgttttcgctctttctgctctttctcccgtagcgttggcagcaaaaggtgatcctcatgtgctgttaaccacctccgccgggaatattgagctggagctgaacagccagaaagcgccggtttctgtgaaaaactttgtcgattacgtcaacagtggtttctataacaacactacgtttcaccgcgttattcctggctttatgattcagggtggtggttttaacgagcagatgcagcagaagaaaccgaatccgcctattaagaatgaagccgacaacggtctgcgtaatactcgcggcacgatcgcgatggctcgcaccgcagataaagacagcgccaccagccagttctttattaacgtcgcggataacgcttttctcgaccacggccagcgcgactttggctatgcggtatttggtaaagtggtaaaaggtatggatgtcgccgataaaatctcacaggtaccgacgcacgatgtcgggccttatcagaatgtgccgacaaaaccagtcgttatcctttccgcgaaagtcctgccataaaacatgcctgcgcgggtgcgagccgcccgcgttttctccctgtctcagcgtaacctgaaattgctgcttatacttgtggtcaatcacaggcatattcagggaggccaggtgaagaaacttaccgataaacaaaagtcacgcttttgggaacagcggcgcaacgttaacttccagcaaagccgccgtctcgaaggtattgagatccccttagtaaccctgaccgccgatgaagcgctggcacgtcttgacgagcttcggaggcactatgagcgataaatttggcgaagggcgcgatccgtacctctatccggggctgaatgtgatgcgtaatcggctggggattcatcaggcccagcgactggcgcaagcggcatacgaaatgaccgcgctccgcgccgctacgattgaactggggccgctggtacgcggcttgcctcatctgtgcgcgattcatcgccagctctatcaggatattttcgactgggcagggcaactgcgggaggtcgatatttaccagggcgatacccgtttctgccactttgcctatatcgaaaaagagggcaatgccctgatgcaggatctggaagaagagggctacctggttggtctgacgcacgagaagtttgtcgagcggctggcgcattactactgtgaaattaatgtgcttcatccgtttcgtttggggagcgggctggcgcagcgcatcttctttgaacaactggcgctacatgcaggctacgcgctgagttggcaaggtattgcggttgaaacatggaatcaggcgaaccagagcggcgcgatgggcgatctctccgctttgcgggcgatttttcagaaagcgataagcgaagctcgcgaaactgagtaaaatagggcggttctactgacccggagccgccatgatcctgcttatcgataactatgattcctttacctggaacctctaccagtatttttgtgaactgggcgcggaagtgcaggttcggcgcaatgatgcgctgacgctggcgcacattgacgctttgaacccgcaaaaaatcgttatctctcctggcccctgtacgccaaatgacgctggcatttcactggcggtcatccgccattatgccggacgtattccgatgctgggcgtttgcctgggtcatcaggcgatggcgcaggcctttggcgcgtcggtggtgcgggcagcgaaagtgatgcacggtaaaacgtcacctgttacgcataatggacagggcgtgtttcggggattgcccagcccgttaaccgtgacacgttaccactcgctgattgtcgaccctgccacgttgcctgagtgttttgagatcaccgcctggagcgaaacgcaggagattatgggcattcgccaccgcgagtgggatctggaaggcgtgcagttccacccggaaagtattctcagcgaacaaggacacgctctgctggaaaatttcctccggcgttgatttgtggttgctattgagtgattttttattcatattttgtgattataatttcactggcatttctacttaaccgggtggtaatgatatggcaactgaacaaacggctattacgcgcgcaacttttgatgaggtaattctgcctgtttatgcaccggcggactttattccggtcaaaggtaaaggcagccgcgtatgggatcagcagggcaaagagtatatcgatttcgccggcgggattgcagtgactgcgctgggccattgccatccggcactggtcgaggcgctgaaatcccagggggaaaccttgtggcataccagtaacgtttttaccaatgaaccggcgttgtgtctgggacgtaaactgatcgacgccacgtttgccgagcgcgtgctgtttatgaattccggcaccgaagcgaacgaaaccgcttttaaactggcgcgtcattatgcctgcgtgcgccatagcccgttcaaaacgaaaatcattgccttccagaacgcctttcatggccgttccttgtttaccgtctctgtaggcgggcagccgaaatattccgacggctttgggccgaaacccgccgatattattcacgttcccttcaacgatcttcatgcggtgaaagcggtaatggatgaccacacctgcgcggtggtagtcgagccgattcagggtgaaggcggcgtgcaggcggctacaccggaattcctcaaagggttacgcgacctgtgtgacaagcatcaggcgttgctggtgtttgatgaagtgcagtgtgggatggggcgcaccggagacctgtttgcctatatgcactacggcgtcacgccggatatcctcaccagcgccaaagcgttaggcggcggttttccggtgagcgccatgctgaccacgcaggagatcgcctcggccttccatgtcggttcgcatggttcaacctatggcggcaatccgctggcctgtgcggtggctggcgcggcattcgatattattaatacgccagaggtactacaaggcattcacactaagcggcaacagtttgtgcaacatttgcaggcgattgacgagcaatttgacattttcagcgatattcgcggcatggggctgctgattggcgcggaactgaagccgaagtacaaaggtcgggcgcgcgattttctgtacgcaggcgcggaggccggcgtgatggtgctcaatgccggagccgacgtgatgcgttttgccccgtcgctggtggtggaagaggcggatatcaatgaaggaatgcagcgctttgcgcaggcggtagggaaggtggtggcctgatggcggattgccggataagcgtagcgcatccggcagtcggtcttaaccttttgtatcccgtagccgcttactcagccagataccgtgatgcggacgctgacgccaggccatcgacgaaatggtgtgcatggtgttcagatggccaatgatgcgctgtaaatgttgttccagagtgctcaataagccatgtgacggcatgtccggcgactccagaatattgacatcgccggagccgcctggcctgtcgtactctaggcgctgctggcagcgctgaatcgcaatctcgcaagattccagatagcgctgcgccagatcaggcgtcagcatggtgtgttcccgcgccagcgtcgtcatagcgttgatatgctcgacaataaactggctgtgcgtgacccacagtttcatatccgacagatagtgggtattgaatccgggttcctgcattgcctgatttaacgagttgaataacgtgttatgcgcctggttgacccgcattctttgataagcgagcggggtggcctgcggatcgttactgaggatcagtcggatagcttcttgatcggcttccagcgcatcatgggcgtttttacgtaatagcccgctttgccattgcggccacagccagaccatgccgccaaaggcaattaaacagccaatcagcgtatcgatcagcctcggcacaataaactgctctccgtttaacgtcagtaactggatggtgtataccgccgtcaccgtaaagccgaccgtcgcccagccgtagtttttacgaataatcagataacttgccagcgttagtaccagcatgaccgccagcgtaatgctttcgggaatatgtaagtgcagcgtgacgccggcaatcaccaggccgaccagcgttccgaccgaacggtgcagaatacgtacgcgcgtcgcgccatagctgttttgggtgacaaacagcaccgtcatgaggatccagtacggtttaggcaggtgcaacgcgctgcccatcagactggcgatgctcatcatcacgctgatgcgtccggcgttgcgtagcgccggcgattttagagacatataatttttcagcgccggaagtagcggcagacgacgctgtttatcggccatcaggtcgcgggcgtacagcggccgctgagtacgcagcacacgggcgattcgactgaagtgccaatagcagaactggcctaccggattttcaggatgctgattagcgatcttctccagagcgccaatctgtttttccatggagaagcgcgtcggcagacgatgataaagaatgtcatccgccagcacgcgcagacgggcggcgaccgtttgcgcattccagcgaatcacctcttccgcatggctgcgttctaccagtttctgtacctcttccggctgatgcaagctgacggagatgtgctcctgcaaatccatcgcttcctgaaaagcccgtagtagacgcttgtaatcattattgttgtgcgccgaaagcatatgcatctgttggtaacactgggtaatgagatcgaccgctttttgctggcgtatcagcaggggaggcagcgctttttccggatcgatatgttgggtgagcaggctgtatttcgcttcacaataatcggccagttcacggtataacaaactcaatgactcgcgcagcggctgttcgcgccatagtcagaaccaaaaccagttaaacacgccgtaccatagcgtgcccagcgcataaatgagcagcggctcccagacgggcatgtatcccgcaaggctcagggtaaagatggcggcaatcagcgacgctggcagtagccgcgcgtgaagcgggctaatttccgccgtcacgccaagcaccagcgtgagcccggtcaggatcaacggcagggggatggattccgccagcagaagttgcgttaccagactgcatccggcgaacagcgacgcgccgatgatcaggcgtttaaaaaagcgtttgtgcggggtatccagacctgcaatgttgcagcaggcgggaacgagagagaaaagcaagcccaggtgtagctggcctatcaataaaccaacagccacaggcaggcacagcaccagcgtttgccgtagtgcgtaattaatctctgggtgataaatcagtcttcgccacatcgatgcaaacaaaaatggcgcatgataaaacgcgccattctgacgggattaacgggtgccgtagacgacgatggtcttgccatgcgcggagatcaggttttgatcttccagcattttcaaaatacgaccaacggtttcgcgggagcagccgacgatctggccgatttcctgacgggtgattttgatctgcatcccatccgggtgcgtcatggcatcgggctgtttcgccagattcagcagcgtctgagcgatacgcccggtgacgtcaaggaaggcgaggttacctactttttcagaggtgacttgtaagcgacgagccatctgggaagagaggcgcatcagaatatccgggttgacctggattaattggcgaaattttttgtaggaaatttcagcgacctcacatgcggttttcgcacgtacccaggcgctgcgttcctggccttcttcaaacaggcccagttcaccaataaaatcaccctgattcagataagaaaggatcatttctttcccttcttcatctttgatcagcactgccacggagcctttaacgatgtagtacagcgtttctgctttttcaccctggtgaatcagcgtgctctttgacgggtacttatgaatgtggcaatgagacaagaaccattcaagagccgggtctgtttgcggtttgccaagcaccatgcgcggttatcctctgttataagctgtctccagagccagaaaacggcactgtctctgaggttgcaaaaatatacttcccgctacctgggaagggggctacgaaaatagattgtagcctgtaatgtgatgtcctctgcatacatgcagtacgtcaatgtattactgtagcatcttgtctgttttagcatagctttcgccgtgtgtctcctggtgtctcgcttcagcatgacccaggtcgccttccattgcgagttttgttgtatgcgcgtaatctttcaggaaaattgaaacattggagttacgaaatatgcaagcgcgtgtaaagtgggttgaaggactcacgttcctcggagagtcctcctccggccaccagattttaatggatggtaactccggtgacaaagcgccgagcccgatggagatggtattaatggcggctggcggatgtagcgctattgatgtggtatcaattctgcaaaagggccgtcagaatgtcaccaactgcgaagtgaagctaacatccgagcgccgggaagacgcgccgcgcctgtttacgcacattaatttgcattttatcgttaccggcggcgatctgaaagaggctgccgtcgcgcgcgctgtcgatctctccgcggaaaaatattgctcggtggcgctaatgctggaaaaagcggtcaatattacccattcgtatgaagtgattgcggcgtaacacgtgatgccggatggcggcgtggccttatccggcctacccgtttttatctcgtaggcccgataagcgtagcgccatcgggcatttcaccgcggttattcgatttttttgccttccattaatcgctgcaccagcggcaacataatcagctccatcgccagccccattttgccgcccggcaccactaatgtattaatgtgagaaatgaacgagccctggagcatcgccaggagccagggaaaatcgatcccttccaggttgcggaaatggatcaccacaaaactctcatccagcgagggaataccctttgcggcgaacggattggacgtgtcgacggtcggtacgcgctggaagttgatatgggtacgcgagaactgcggcgtaatgtaattgatgtagtcgtccatggaacgcaccacggaatccatcaccgcttcacgggagtgtccgcgctcgctggtgtcgcggattagtttctgaatccactcaaggttgacgataggcaccacgccaaccaacagatcaacatgacgcgcgacatcatgttgtggggtgacgacgccgccgtgcagtccttcataaaacagcacatcggtcggttcaggaagcggctgccagggggtaaacgtgccgggaacctgattccacggtacggcttcatcataggtatgcagatatttacgcgactggcctttacccgtctgcccgtactcaataaaggtatgttccagtaggctgaagtcattggcttcaggcccgaaatagctgatatgccgcccggcgtcacgcgctttgcggatcgccatgtccatttccgggcgggtgtaacgatgaaaactgtcgccttccacctcggcggcatgcagatttaactgcgcgaaaattttacgaaacgcgaggctggtggtggtggtccccgcgccgcttgaccctgttactgctatcaccggatgtttggctgacatggcaactccatgattgagctttattaataatgtattgtcggcaaaggcgttttattcgcgaaactgctttttcggcataatattgaccgtttcatgtaattcagaccataccagcacggcctcgccggattgcagttggcgttttacgtcagcgactttttgttcaagcgaacgttcatgttcaccataatcggtgccttcgcgcaacacaaagctttcgatcaggttgtccagcgtgtcgggggcgagcccctgccagggaatgatcatgatgacgcctccaggtacgttgtcagccagtcaggaattcggcgttccagccacatttcagggcgcagtggcgtaccgccgataaatcctacgtgtccgccatgctcagtcagctgatactccacctgcgggggcagatcttccgctttagggatcacatgatgatccataaacggatcgtctttagcgtgaataatcagcgtcggtttagcaatctggttaagcaacggcatggcgctacactgacgatagtagtcgatggcgtcggcaaagccgtgaattttcgcggtgatcaggtcgtcaaattcgcgaatacggcgcattgatttcagttgcgccagattcaccggcagcgacccgggatacgccgccagcttgcgtgacgcattcgcttttaacagattaagcaaataacgctgatagacgcgggaaaaccctttgtccatgtggtagctacaggcttcgagaacgaaaggcgcagaaacaattaccgccgcctcgatgggaatatcgcggccttctttcgccagcaggcacgccagcatattaccgccgagcgaatagcccacggcggctgtcggaacggcgccgaactcccgctgtagccagcgtaaaaaccaggctccgtcctccgtttcaccggagtggtaaatacgattcagacggttgggttcgccgctacagccgcgaaagtgcatcaccacgcccagccagccgcgctttatgctttgcctgttgcggttcttcgctccatgccagatcgacaaaatcgccgtccggtagctccagccgctgccagtgggcgttgaacttcactttgcggcggattaaacgtggcagcatagtttgtaaatggcgattacgaatgccacgcatgggaataaattcatgcgagtcattgacaggcggggtcatttctgtggacgtgatctcaaccatagcaccagaacaattgataattggaaacaatactataccgcgcataaggttcacagattagtcaatatgtgattttacgttcaattggtcgtctggcgaaataaaattgcgcctcatttcaccagagggggcggtatgcaaggcgcgcgcaataccccacagaaatcgcgtgaacctctgcatcagccgaattaatcgtggtagtgtggcaacacgatagttatgtgactcaaggagaaggcatgtcgaagacacttttacagatccattttaactttagcggcccttttggcgaggagatgactcagcaactggtcgggctggcggagtctatcaatgaggagccgggcttcatctggaaaatctggacagaaagcgagaaaaaccagcaagctggcggcatttacttgtttgaatccgaagaaacggcgcaggcttatattaaaaaacacactgcgcgtctgaaaaatcttggcgttgatgaggtgacgtttacattatttggcgtgaacgacgcgctgacgaaaataaatcacggcaacctttgccgctaactcacataacgcaggcttctgttccggtgctgccgaccgcaacggtaacctttatatcgggacgagtaccgaagaggcctttatggacgaacagtggacaacgaacgttctcttccagcgtgtgcagcgtctcggcggtgcgggcgatgttacccttctccacaagcatcatgaagatggtgagcttgcggaaggtaatgtcatcggtgatagacaggttcatcgtccgccccgtgcgttagagcctatcccagtaggcgtaattgttgaagccagtttggggccggacagcgcgcagaaaccgtgaggatttcgagcactgcccggccctaaaatggcgaataaaatagcctaatgggataggctcttagtcgttctgcatcatctgctcaagctgctcctgcgcctcaagccatgccatttcacattcttccagcccggatttggcgctggcctgcagttgcagacactcggtcatctccgctttacggcttgggtcatacaggctgctgtcgccaagcttctcttccgcctgcgccagttgggcgttgagcttttccatctctttttccagacgggtaatctctttacgcagcggctgcgttagagtgcgtagctcggcttcgcgacgcttctgatctttgcgtgactgagcgctgttggcgttgttttccttcggtgcgtcgtcggcctggttttcctgcttctgcacgtcgctcagccactgctgataatcctccaggtcgccgtcgaacggttcgacctttttgtcgtgaaccagatagaggtcgtcggtggtggagcgaatcaggtggcggtcgtgcgacacgacgaccaatgcgccttcgaaatcaatcagcgcttcggtgagcgcctgacgcatgtcgagatccaggtggttggttggttcatcgagcagtagcagatttggacgctgccagacgatcagcgccagtaccaggcgcgctttctcgccgccggagaaacgttgcgtctcttccgttactttgtcgccctggaaaccgaagccgccgagatagtcgcgcagcttctgctccagttcctgcggcgccagacgcgccatatgctgcagcggggattcatcggcgcgcaggaactccagttggtgctgggcgaagtagccgagcttaatgcctttggcgaggccgatttcaccgtgcaacggttccagttcgcccgccagcagcttgatcagcgtcgatttccccgcgccgttgcggcccagcaggccgatacgcgagccgggcaccaggttcagcttgatggattccagaatgatgcgatcgccataacctgcgctgactttttccatcttcagcagcgggttcggcaggctttccggcgcgcggaagctgaaatggaacgggttgtcgacatgagccggcgcaatcaactccatacgctccagcatcttgatacggctttgcgcctgcttggccttggtggccttggcgcggaaacggtcgatgtagctttgcagatgcgccacacgctcctgctgactctcatacatcgcctgctgctgcgccaggcgcgtggcgcgctgaacttcaaacgcgctgtagttaccggtgtactcgaacagagtctgctgttcgatatggataattttatccactatcgggtcaagaaaatcgcgatcgtgggagatcagaatcagggtgcctggatagctcttcagccatttttccagccagataacggcatccagatcgaggtggttggtcggttcgtcgagcagcagtaaatcggaacggcaaatcagcgcctgggccagattaaggcgcatccgccagccgccggaaaagtcgctgaccggacgttccagctgatcgttagagaagccgaggccgtgtaacaggctggcggcgcgcgagcgaacggtccatgcgtcgatggcgtccagcttaccgtgtatggaggcgatagcatgcccgtcgttacgttcgttggcgtcgttaagctgcgcctccagatgccggtattcacggtcgccgtcaatgacatactcaatcgctggctgaggcaacgcaggtgtttcctgattcacccacgctaattgccaggttccgggcagggtaaaactcccggcatcggcgctgatttcattttttagcaatgccagcagggtagatttaccgcagccgtttttacccaccaggccgactttctggcctggattaatggtagccgaggcattgtccagtaggacgcgcacgccgcgacgaatttgtaacgaggagaaaacaatcataaggcgccgtatgttcagactatgttaatttatcattatgataatgtaatattcgggcgtaccgccgcgctggagcgcaatggtagctcaaaacaacaacgatacacaaaatcattcaggccgcctttggtgagggacaagaatatctctcattaatccccagcggcggacatggagtacgtttctgagttgaacaaacgctgtcaacgtagaagcggcctgaagaatggcatgtatcgacccaaaacaaccgggagggggattgatgtctcagccagcgaaagtcttgctgttgtatgcccatccggaatctcaggactcggttgctaaccgggtactgcttaaaccggccatacagcacaataacgtaaccgtgcacgatctttatgcgcgctatcctgatttttttatcgatacgccctatgaacaagccctgttacgtgagcacgacgtcattgtttttcagcatcccctttacacctatagctgtccggctttactgaaagaatggcttgatcgcgttttgagtcgagggttcgccagcggaccagggggaaaccaactggtgggaaagtactggcgtagcgtgattacgaccggcgagccggagagcgcttaccggtatgacgcgctaaaccgctatccaatgagcgatgtactccgcccttttgaactgaccgcggccatgtgccggatgcactggatgccgcccattattgtgtactgggcgcgccgccagtcgccgcagacgctggccagtcatgcgaaagcctatggcgagtggctggcgaatcctgtgagcgcgggaggctattgatggaaggtgctgatttattgaccgcgggagtgttgttcctcttcgcggcggtagcggcggtgccgctggccgcgaggctgggcatcggcgcggtgctagggtatttgctggcgggaatcgccatcggtccgtgggggctgggatttatcagcgatgttgacgagatcctgcacttttccgaactgggcgtcgtgtttctgatgtttatcattggtctcgaactcaatccgtcacggctttggcaactgcggcgctctatcttcggcgtcggcgctgctcaggtgctgttaagcgcggcggtgctggcgggattattgatgcttgctgatttcttatggcaggcggcggtcgtcggcgggattggcctggcgatgtcttcgacggcgatggcgctacaactgatgcgcgagaaaggcatgaatcgtagcgagtccgggcagttagggttttccgtcttactgtttcaggatttagcggtgatccccgcgctggcgttggtgcctttattggcgggatcggccgacgagcatttcgactggtttaaagtggcaatgaaggtactggctttcgcggtaatgctgattggcggtcgttacctgctgcgcccggtatttcgttttattgctgcgtctggcgtgcgggaggtcttcactgccgcgacgctgttgctggtgttgagcgccgccttatttatggatgcgctgggactgtcgatggccctgggaaccttcattgccggcgttttactggcagagagcgaataccggcatgagctggaaaatgctatcgatccctttaaaggtttactgcttgggctgttctttatctccgtcggtatgtcgctaaatctcggcgtactttatacccatttactgtgggtggcggcgagcgttgttattctggtcgtcataaaaatgctgacgctgtatctgctggcgcggctatatggaataagaagttctgaacggatgcagtttgccagcgtgctgagtcaggggggcgagttcgcttttgtgctcttttctaccgcctcttctcagcgcctgtttcagggcgatcagatggcgttattattggtgactgtcacattatcaatgatgaccacgccgctactgatgaaagggattgataagtggttatcgcgccgtcttaatggcccggaagagaatgatgaaaagccgtgggttgaggatgataagccccaggtggttgtcgtcggctttggccgttttggtcaggtgatcgctcgcttattgatggcgaataagatgcgtatcaccgtgctggaacgcgatatcggcgccgttaatctgatgcgcaaatatggttataaagtgtattacggcgacgctacacaagtcgagctgctgcgttctgcgggcgcggaggcggcggagtcgatagtcatcacgtgtaatgaaccggaagacacgatgaagctggtggcgctgtgtcagcagcattttcctcatctgcatattcttgcgcgagcgcgtggacgtgtggaggcccatgagttattacaggctggcgtcacgcagttttcccgtgaaacgttttccagcgcgctggaactgggacgtaaaactctggtgtcgttaggtatgcatccgcatcaggcgcaacgcgcgcagttgcattttcgtcggctggatatgcgaatgttgcgggagctgatcccggagcatagcgacatggtacagatttcgcgcgccagagaggcccgacgcgagctggaggagatttttcagcgcgaaatgcaacaggaacggcgccagttggatggctgggatgaatttgagtagaggtgaacaatggcaatccgtaaacgttttattgcaggcgcgaaatgtccggcctgtcaggcgcaggatacaatggcgatgtggcgtgaaaataatgtcgatattgttgaatgcgttaagtgcgggcatcaaatgcgggaagcggataaagacgttcgcgagcatgttcgcaaagaagagcaagtgatcgggatttttcatccggactagcgatatgccgcaggtttttttaagctaaggggtacacggctgcagaattccgctacaatctgcgccactattcttcccatgctcaggagatatcatgaaagtagcaaaagacctggtggtcagcctggcctatcaggtacgtacagaagacggtgtgttggttgatgagtctccggtgagtgcgccgctggattacctgcacggtcacggctccctgatctctggtctggaaaccgcgctggaaggccatgaagttggcgacaaatttgatgtcgctgttggcgcgaacgacgcttacggccagtatgacgaaaatctggtgcagcgtgtgcctaaagacgtctttatgggcgttgatgaactgcaggtagggatgcgtttcctggcggaaaccgaccagggcccggtaccggtagagattaccgaagtggaagacgatcacgttgtggttgatggtaaccacatgctggcgggccagaatctgaaatttaacgtcgaagttgttgcgattcgtgaagcgactgaagaagaactggctcacggtcatgttcacggcgcgcacgatcaccaccacgatcacggtgaagacggctgctgtagcggtcatggtcatgaccatggtcacgagcacggcggcgaaggctgctgcggcggtggtggtaaaggcagctgcggctgccattaatccccgtcgtctttcaagccaccgcggtgttggctacgctttcaaaccccggtcacatcgttatctatgttcccggggaattttcaagcttgccgctttgctgtgactcgaaatccttaggttattatcattggttcgataaatcatcgggcacaaaaaaagcgggtatccccgctttttttcgtctcaataatgcggcggcggcgtttcttctgcctgagaggcgatatttgacggctgactggcttttaacttttccgtgagcaaacgcagatgattgcgcagcttcgccatctccatttcatgtgcggttaccgtcaggtttagttcttctatggtaatctcctggaacgccagacggctttccagttcagccagacgagcttccatcgtgatatcctgcatgatgtacctctttatgttgtctccgtcggcggattctacttaactttaccggctttcacagcaaccattacgcgccctacgaaactaatttaaacaaaaagagtctgaaaagaagtgataatagggcgtgttcgtatgttgatttgttctgcaacgatttatagtacgcttcttacgtaagttaacatggggcgagatgccccggccctggagatatggatgaaatcactgtttaaagccacgctgctggcaacgacgatggccgttgctatgcacgtaccgatcacttttgctgctgatgcggcgaaaccggcagctaccgctgatagcaaagcagcatttaaaaacgacgatcaaaaagcggcttatgcgctgggcgcctcgctgggtcgttacatggaaaattcgcttaaagagcaggaaaagttgggcatcaaactggataaagatcagttgattgccggcgttcaggatgcctttgccgataagagcaaactgtccgatcaggaaattgagcaaacgctgcagacgtttgaagcacgtgtgaagagcgctgctcaggcgaagatggaaaaagacgctgccgataacgaagcaaaaggtaaaacgttccgtgacgcttttgctaaagagaaaggcgtgaaaacctcctctaccggtctgctttacaaagtagagaaagaaggcacaggcgaggcgccgaaagatagcgataccgttgtggtgaactacaaaggtacgctgatcgacggtaaagagtttgataactcttacacgcgcggcgaaccgctctccttccgtctggacggcgttatccctggctggactgaaggcctgaaaaatattaagaaaagcggcaagatcaagctggttatcccaccggcgctggcctacggtaaaacgggcgttccgggtatccctgcgaactccaccctggtattcgacgtagagctgctggatatcaaaccagcgccgaaagcggatgctaaacctgccgatgcggctgacgctaaagccgcagatgctgctaaaaaataaaaactgagagccgccgcttgtaatagcggcggttttttttattcaggccggatatattactcaccataatttgatttgcggataacggcgcttgcgctggtcgttaagggcgagaccgtaggctgaatgaccgccaacgcacacgtagtctgaaatagacgagcaaattagtactggaaagatgaaccctcactgtattaatttaatcatccgcgtaaataatgagcctgccctgaaaacataacgacaggctcctgaaaaggagtgttttttttcatgtccaggtcgcttttaaccaacgaaaccagtgaacttgatttgctggatcagcgtcccttcgagcaaaccgacttcgatattctgaaatcctacgaagcggtagtggacgggttagcgatgcttataggttcccattgtgaaatcgtattgcactctttgcaggatctaaaatgttcagccattcgtattgccaatggcgaacatacgggccgtaaaattggctcgccgattaccgacctggcgttgcgcatgttgcacgacatgacaggggcggacagtagcgtgtcgaaatgctattttacgcgcgcgaaaagcggtgtcttgatgaagtcgttgacgattgccattcgcaaccgcgagcagcgcgtcattggtctactgtgcatcaacatgaatcttgatgtgccattttcacagattatgaatacctttattccgccggaaacgccggaagtcggctcagcggttaattttgcctcctcagtcgaagatttagtcacccagacgctggagttcacgatcgaagaagtgaatgccgatcgtaatgtctctaacaatgcgaaaaatcgtcagatcgtccttaacttgtacgaaaaaggcattttcgatattaaagacgccattaaccaggtagccgatcgtctgaatatctcaaaacacacggtttacctctatattcgccagttcaaaagcggcgattttcaggggcaggataaataatgcgttatgccattatggtcaccgggcctgcatatggcacccagcaggccagcagcgcattgcagttcgcccacgcgctgctcaatgaggggcatgagttagccagcgtctttttctatcgggaaggtgtctataacgccaatctcctgacctcgccggcgagcgatgaatatgatctggtacgcgtctggcagaaattgaatacgcagcatggcgtagcgctgaacatctgtgtcgcggcggcgcttcgtcgcggtattattgatgaaactgaagccggcagactggagttgccgtccgccaatcttcagccgggctttacgctaagcggactgggcgcgctggcggaggcttctctcacctgcgatcgggtggtgcagttttaatgaaacgtattgcatttgtcttttccaccgcgccgcacggtagcgcctcaggccgtgaaggactggatgcgctgctggcgacgtcagcgctaacggaagcgctgggcgtcttttttatcagcgacggcgtctttcagttattaccggggcaaaaaccagacgctgtgctggcgcgtgactatattgctactttcaagctctttgatttgtacgatattgatcaatgctggatctgcgcggcatcgctgcgcgagcgtggtctggaaaacgttaattttgtggtaaacgccacgccgctggaacccgtggcgttacgccgcgagcttggcaactatgatgtcatcctgagattctgaggcgtttatgctgcataccttacctcattgcgcttcgggcgttgattttcccgctttgctgcgcctgctaaaagagggcgatgcgcttttgctgctccaggatggcgttaccgtcgcgattgaaggtaaccgcttccttgaaagtctgcgcgatgcccccataacggtctatgccttgaaagaagacattgacgctcgcggcctgggtggtcaaatttcagacagtgtcgtcagggttgactatactgagtttgtcagactcacggttaagtatgccaaccagatggcctggtgatggcgggatcgttgtatatttcttgacaccttttcgacaccgccctaaaattcggcgtcctcatattgtgtgagggcgttttattacgtgtttacgaagcaaaagctaaaaccaggagctatttaatggcaacagttaaccagctggtacgcaaaccacgtgctcgcaaagttgcgaaaagcaacgtgcctgcgctggaagcatgcccgcaaaaacgtggcgtatgtactcgtgtatatactaccactcctaaaaaaccgaactccgcactgcgtaaagtttgccgtgttcgtctgactaacggttttgaagtgacttcctacatcggtggtgaaggtcacaacctgcaggagcactccgtgatcctgatccgtggcggtcgtgttaaagacctcccgggtgttcgttaccacaccgttcgtggcgcgcttgactgctccggcgttaaagaccgtaagcaagctcgttctaagtacggcgtgaagcgtcctaaggcttaatggttctccgttaagtaaggccaaacgttttaaattaatgtcaaactaaactcgtagagttttggacaatcctgaattaacaacggagtatttccatgccacgtcgtcgcgtcattggtcagcgtaaaattctgccggatccgaagttcggatcagaactgctggctaaatttgtcaatatcctgatggtagatggtaaaaaatctactgcagaatcaatcgtatacagcgcgctggagaccctggctcagcgttctggtaaatctgaactggaagctttcgaagtcgctctcgaaaacgttcgcccgactgtagaagttaaatcccgccgtgtaggtggttctacttatcaggtaccagttgaagtccgtccggtccgtcgtaatgctctggcaatgcgttggatcgtagaagctgctcgtaaacgcggtgataaatccatggctctgcgcctggcgaacgaactttctgacgctgcagacaacaaaggtactgcagttaagaaacgtgaagacgttcaccgtatggcagaagccaacaaggcgttcgcacactaccgttggtaatcccttcggagtcatagtcaccaggcgggcgcttcaggtaagtcgcccgttttggataacttaactgaacgcctaaagatatcaacgaggaatcaaatggctcgtacaacacccatcgcacgctaccgtaatatcggtatcagtgcgcacatcgacgccggtaaaaccactactaccgaacgtattctgttctacaccggtgtaaaccacaaaatcggtgaagttcatgacggcgcagctaccatggactggatggagcaggagcaggagcgtggtattactatcacctccgcagcgactactgcattctggtctggtatggctaagcagtatgaaccgcatcgcatcaacatcatcgacaccccggggcacgttgacttcactatcgaagtagaacgttccatgcgtgttctcgatggtgcggtaatggtttactgcgcagttggtggtgttcagccgcagtctgaaaccgtatggcgtcaggcaaacaaatacaaagttccgcgcattgcgttcgttaacaaaatggaccgcatgggcgcgaacttcctgaaagttgttggtcagatcaaaacccgtctgggcgcgaacccggttccgctgcagctggcaattggtgctgaagaaggtttcaccggcgttgttgacctggtgaaaatgaaagccatcaactggaacgatgccgaccagggcgttaccttcgaatacgaagatatcccggctgacatgcaggacctggctaacgaatggcaccagaacctgatcgagtccgccgcagaagcttctgaagagctgatggaaaaatacctgggtggtgaagaactgactgaagaagagatcaaacaagctctgcgtcagcgcgttctgaacaacgaaatcatcctggtaacctgtggttctgcatttaagaacaaaggtgttcaggcgatgctggatgcggtaattgattacctgccatccccggtagacgtacctgcgatcaacggtattctggacgacggtaaagatactccggctgagcgtcacgcaagcgacgacgagccgttctctgcgctggcgttcaaaatcgctaccgacccgtttgtgggtaacctgaccttcttccgtgtgtactccggtgtggttaactctggtgataccgtactgaactccgtgaaaaccgcacgtgagcgtttcggtcgtatcgttcagatgcacgctaacaaacgtgaagagatcaaagaagttcgcgcgggcgacatcgcggctgctatcggcctgaaagacgtgactaccggtgacaccctgtgtgatccggaaaacccgatcattctggaacgtatggaattccctgagccggtaatctccatcgcggtagaaccgaaaaccaaagctgaccaggaaaaaatgggtctggctctgggccgtctggcgaaagaagacccgtcgttccgcgtatggactgatgaagaatctaaccagaccatcatcgctggtatgggtgaacttcacctagatatcatcgttgaccgtatgaagcgtgaattcaacgttgaagcgaacgtgggtaaacctcaggttgcttaccgcgaagcgattcgcgcgaaagttaccgacatcgaaggtaaacacgcgaaacagtctggtggtcgcggtcagtatggtcatgttgttatcgacatgtacccgctggagccgggctctaacccgaaaggttacgagttcatcaacgacatcaaaggtggtgtaattcctggcgagtacatcccggccgttgataaaggcatccaggagcagctgaaatctggcccgctggcgggttatccggtagttgatctcggtgtgcgtctgcacttcggttcttaccatgacgttgactcctctgagctggcgtttaaactggctgcgtctatcgcctttaaagaaggctttaagaaagcaaaaccagttctgcttgagccgatcatgaaggttgaagtagaaacacctgaagagaataccggtgacgttatcggcgaccttagccgccgtcgtggtatgctcaaaggtcaggaatctgaagttacaggcgttaagatccacgctgaagtaccgctgtctgaaatgttcggatatgcaactcagctgcgttctctgaccaaaggtcgcgcatcgtacactatggaattcctgaagtatgatgatgcgccgaacaacgttgctcaggccgtaatcgaagcccgtggtaaataagccgcagggttaaaaaccaaaatcccgtgctctctcctgaaggggagagcgctatagtaaggaatatagccgtgtctaaagaaaagtttgaacgtacaaaaccgcacgttaacgtcggcaccatcggccacgttgaccacggtaaaactaccctgaccgctgcaatcaccaccgtactggctaaaacctacggcggtgctgctcgtgcattcgaccagatcgataacgcgccggaagaaaaagcgcgtggtatcaccatcaacacttctcacgttgaatacgataccccgacccgccactacgcacacgtagactgcccggggcacgccgactatgtaaaaaacatgatcaccggtgctgcgcagatggatggcgcgatcctggttgttgctgcgactgacggcccgatgccgcagacccgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacacgccgatcgttcgtggttctgctctgaaagcgctggaaggcgacgcagagtgggaagcgaaaatcatcgaactggctggcttcctggattcttacatcccggaaccagagcgtgcgattgacaagccgttcctgctgccgatcgaagacgtattctccatctccggtcgtggtaccgttgttaccggtcgtgtagaacgcggtatcatcaaagtgggcgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccacacaccaagttcgaatctgaagtgtacattctgtccaaagatgaaggcggccgtcatactccgttcttcaaaggctaccgtccgcagttctacttccgtactactgacgtgactggcaccatcgaactgccggaaggcgtagagatggtaatgccgggcgacaatatcaaaatggttgttaccctgatccacccgatcgcaatggacgacggtctgcgtttcgcaatccgtgaaggcggccgtactgttggcgcgggcgttgttgctaaagttctgggctaattactcgttaattagttttgaattgaagagggcgcttcggcgccctttttgttgcctgctatttagccgctgttatatttatttgccttttttaacgcttctcccgtggcgtaaatcgctttgtgctattgtaatcataaccattctcatttacactttgtgcggaaattgaacgggagcgatcatgtacgtttgtttgtgtaatggtataagcgataaaaaaatccgccaggctgtacgacaatttcatccacagtcatttcaacagttgcgtaaatttattcctgtgggaaatcaatgtggtaagtgtattcgcgccgcgcgagaagtgatgcaggatgagttaacgcaaatgccggaatttaaagagatcgcctgagtcacactcttttttttgacatccctgtagccccatctacgctctagagagtggaagcggagggactataaaatgaaaggtgatgttaaaatcataaattatctcaataaactattgggaaatgagcttgtcgcaattaatcagtattttcttcatgcccgtatgttcaaaaactgggggctgacccggcttaatgatgttgagtaccatgaatccattgatgagatgaaacacgccgataagtatattgagcgtattttatttctggaaggcataccgaacctacaggatctgggcaagctgggcatcggtgaagatgtcgaagagatgctacgatcggatctccggctcgaactggaaggcgcaaaagatctacgtgaggcaatagcctatgccgataacgttcatgattatgtcagccgggatatgatgattgaaattcttgccgacgaggaaggccacatcgactggctggaaactgagctggatttgattgccaaacttggtatgcaaaattatctgcaatcacaaattaaggttaccgattaaccgtctggaaagaaaactttccaacctgttatgaaacccgccaccgccagccatggcccaaaaggtagcgggtttattaatgccgatttacctctcaccagtagcgcgacgccaaacctgccacaggccaacatagcggcaaggaaaaccagtaacggcagtgtttcccaacaatgccacgcccctaaggcagcaaggtacttgacgtcgccatatccaagcccctctttctgataacgcaggcgatagccccagtaaattaacgcgaatccgccatagccggcgatagcgccccaaagcgcatccggtaaacgctccggcaggcaaatctggtgataaagcagaccaccccacagtaatggacaggtaaaccggtcaggtagcagaccggtacgcgcgtcgtatatgccaagtaataaagagaacgacgcataaaaaatgagaaaggggagggcaacaaacataagcaaatcctcgtcaaggtttgtgctcacctttatagatttatgcgacagcgacaacgacgtattgccaggtttgcctgatgccttccaaagaaaagatgcgcgtcgccatcccatgcgtaccatctggaatcatgctcgcataagaataaagcgcttaatttctatccgacacttgcgtcaggctgagatttacgtataatgcgcgggcttgtcgtaattgacggcaggttcgatttgaacctcgaatagccgatttggctatttaacaatgctcccaatcggggagctacgtaagaacggttacactctcccatcaatcgtaatgggtgtgaggagtaatcattttcgtttataaaataattggagctctggtctcatgcagaaccaaagaatccgtatccgcctgaaagcgtttgatcatcgtctgatcgatcaatcaaccgcggaaatcgtcgagactgccaagcgcactggtgcgcaggttcgcggtccgatcccgctgccgacccgcaaagagcgctttaccgttctgatctctccgcacgttaacaaagatgcgcgcgatcagtacgaaattcgcactcacaagcgtctggttgacatcgttgagccaaccgagaaaaccgttgatgctctgatgcgtctggacctagctgccggtgtagacgtgcagatcagcctgggttaatcaggtcatcgagcgattgagaggttgatacaatgattggtttagtcggtaaaaaagtgggtatgacccgcatcttcactgaagatggcgtctctatcccagtaaccgtaatcgaagttgaagcaaaccgtgttactcaggttaaagacctggctaacgatggctaccgcgctgttcaggttactacgggtgctaaaaaagctaaccgtgtcaccaagccggaagcgggtcactttgctaaagctggcgtagaagctggccgtggtctgtgggaattccgtctggctgaaggcgaagaatacaccgtaggtcagagcatcagcgttgaactgtttgctgacgttaaaaaagttgacgtaaccggtacctctaaaggtaaaggtttcgctggtaccgttaagcgctggaacttccgtacccaggacgctactcacggtaactccttgtctcaccgcgttccgggttctatcggtcagaaccagactccgggcaaagtgttcaaaggcaagaaaatggcaggtcagatgggtaatgagcgcgtaaccgttcagagccttgacgtagtacgcgttgacgctgagcgcaacctgctgctggttaagggtggtgttccgggtgcaaccggttgcgacctgatcgttaaaccagctgtgaaggcgtaaggggatagcaatggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttccggtaaaaaaccgtggcgccagaaaggcactggccgtgcgcgttcaggttctatcaagagcccgatctggcgttccggtggcgtgaccttcgctgctcgtccgcaggaccacagtcaaaaagttaacaagaagatgtaccgcggcgcgctgaaaagcatcctgtccgaactggtacgtcaggatcgtctgatcgttgtcgagaagttctctgtagaagcgccgaaaactaagctgctggcacagaaactgaaagacatggctctggaagatgtgctgatcatcaccggtgagctggacgagaacctgttcctggccgcacgtaacctgcacaaggttgacgtacgcgatgcgactggtatcgacccggttagcctgatcgccttcgacaaagtcgtaatgactgctgatgctgttaagcaagttgaggagatgctggcatgattcgtgaagaacgtctgctgaaggtgctgcgcgcaccgcacgtttctgaaaaagcgtctactgcgatggaaaaaaccaacaccatcgttctcaaagttgctaaagacgcgaccaaagcagaaatcaaagctgctgtgcagaaactgtttgaagtcgaagtcgaagtcgttaacaccctggtcgttaaagggaaagttaaacgtcacggacagcgtatcggtcgtcgtagcgactggaaaaaagcttacgtcaccctgaaagaaggccagaatctggacttcgtcggcggcgctgagtaagtcggaggagtaatacaatggcagttgttaaatgtaaaccgacatctccgggtcgtcgccacgtcgttaaagtggtcaacccagagctgcacaagggcaaaccttttgctccgctggttgaaaaaaacagcaaatccggtggtcgtaacaacaatggccgtatcaccactcgtcatatcggtggtggtcacaaacaggcttatcgtattgttgacttcaaacgcaacaaagacggtatcccggcagttgttgaacgtcttgagtacgatccgaaccgttccgcgaacatcgcgctggttctgtacaaagacggcgaacgccgttacatcctggccccgaaaggcctgaaagctggcgaccagattcagtctggcgttgatgctgcaatcaaagcaggcaacaccctgccgatgcgcaatatcccggttggttctaccgttcataacgtagaaatgaaaccaggtaaaggcggtcagctggcgcgttccgctggtacttacgttcagatcgttgctcgcgatggcgcttatgtcaccctgcgtctgcgttctggtgaaatgcgtaaagtcgaagcagactgccgtgcaaccctgggcgaagttggcaatgctgagcatatgctgcgcgttctgggtaaagcaggtgctgcacgctggcgtggcgttcgtcctaccgttcgcggtactgcgatgaacccagtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataattttagaggataagccatgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccggtatttgtttccgacgaaatggtcggtcacaaactgggtgaattcgcaccgactcgtacttatcgcggccacgctgctgataaaaaagcgaagaagaaataaggtaggaggaagagatggaaactatcgctaaacatcgccatgctcgttcttctgctcagaaggttcgccttgttgctgacctgattcgcggtaagaaagtgtcgcaggctctggatattctgacctacaccaacaagaaagcggctgtactggtcaagaaagttctggaatctgccattgctaacgctgaacacaacgatggcgctgacattgacgatctgaaagttacgaaaattttcgtagacgaaggcccgagcatgaagcgcattatgccgcgtgcaaaaggtcgtgcagatcgcatcctgaagcgcaccagccacatcactgtggttgtgtccgatcgctgagactctggagactagcaatgggtcagaaagtacatcctaatggtattcgcctgggtattgtaaaaccatggaactctacctggtttgcgaacaccaaagaattcgctgacaacctggacagcgattttaaagtacgtcagtacctgacgaaggaactggctaaagcgtctgtatctcgtatcgttatcgagcgtccggctaagagcatccgtgtgactattcacaccgctcgcccgggtatcgttatcggtaaaaaaggtgaagacgtagaaaaactgcgtaaggtcgtagcggatatcgctggcgttcctgcacagatcaacatcgccgaagttcgtaaacctgaactggacgctaaactggttgctgacagcatcacttctcagctggaacgtcgcgttatgttccgtcgtgcgatgaagcgtgctgtacagaacgccatgcgtctgggcgctaaaggtatcaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttatggtgtaatcggcgttaaagtgtggatcttcaaaggcgagatcctgggtggtatggctgctgttgaacaaccggaaaaaccggctgctcaaccgaaaaagcagcagcgtaaaggccgtaaataaggagcgtcgctgatgttacaaccaaagcgtacaaaattccgtaaaatgcacaaaggccgcaaccgtggtctggctgcaggcgcggatgttagcttcggcagcttcggcctgaaagctgttggccgtggtcgtctgactgcccgtcagatcgaagcagcacgtcgtgctatgacccgtgcagttaagcgtcaaggtaagatctggatccgtgtattcccggacaaaccgatcactgaaaagccgctggcagtgcgtatgggtaaaggtaaaggtaacgtggagtattgggttgccttgattcagccgggtaaagtcctgtatgaaatggacggcgtaccggaagagctggcccgtgaagcattcaagctggcagcagcgaaactgccgattaaaaccacctttgtaactaagacggtgatgtaatgaaagcaaaagagctgcgtgagaagagcgttgaagagctgaacaccgagctactgaacctgctgcgtgagcagttcaacctgcgtatgcaggctgcaagtggccagctgcaacagtctcacctgttgaagcaagtgcgtcgtgatgtcgcacgcgttaagactttactgactgagaaggcgggtgcgtaatgaccgataaaatccgtactctgcaaggtcgcgtggttagcgacaaaatggagaaatccattgttgttgctatcgaacgttttgtgaaacacccgatctacggtaaattcatcaagcgtacgaccaaaatgcacgtacatgacgagaacaacgaatgcggtatcggcgacgtggttgaaatccgcgaatgccgtccgctgtccaagaccaaatcctggactctggttcgcgttgtagagaaagcggttctgtaatacagtacgcattctcaacgaataaacggctcagcgatgggccgtttattttttctacccatatctgatttgcggtgttataatgccgcgccctcgatatggggtttttttaacgacctgattttcgggtctcagtagtagttgacattagcggagcactaaaatgatccaagaacagactatgctgaacgtcgccgacaactccggtgcacgtcgcgtaatgtgtatcaaggttctgggtggctcgcaccgtcgctacgcaggcgtaggcgacatcattaagatcaccatcaaagaagcgattccgcgtggtaaggtcaaaaaaggtgatgtgctgaaggcggtagtggtgcgcaccaagaagggtgttcgtcgcccggacggttctgtcattcgcttcgatggtaatgcatgcgttattttaaacaataacagcgagcagcctatcggtacgcgtatttttgggccggtaactcgtgaacttcgtaacgagaagttcatgaaaattatctctctggcaccagaagtactctaaggagcgaatcatggcagcgaaaatccgtcgtgatgacgaagttatcgtgttaaccggtaaagataaaggtaaacgcggtaaagttaagaatgtcctgtcttccggcaaggtcattgttgaaggtatcaacctggttaagaaacaccagaagccggttccggctctgaaccaaccgggcggcatcgttgaaaaagaagctgcaattcaggtttctaacgttgcaatcttcaatacggcaaccggcaaggctgaccgtgtaggctttagattcgaagacggcaaaaaagtccgtttcttcaagtctaacagcgaaactatcaagtaatttggagtagtacgatggcgaaactgcatgattactacaaagacgaagtagttaacaaactcatgactgagtttaactacaattctgtcatgcaagtccctcgggtcgagaagatcaccctgaacatgggtgttggtgaagcgatcgctgacaagaaactgctggataacgcagcagcagacctgacagcaatctccggtcaaaaaccgttgatcaccaaagcacgcaaatctgttgcaggcttcaaaatccgtcagggctatccgatcggctgtaaagtaactctgcgtggcgaacgcatgtgggagttctttgagcgcctgatcactattgctgttcctcgtatccgtgacttccgtggcttgtccgctaagtcattcgacggtcgtggtaactacagcatgggtgtccgtgagcagatcatcttcccagaaatcgactacgataaagtcgaccgcgttcgtggtttggatattaccattaccactactgcgaaatctgacgaagaaggccgtgctctgctggctgcctttgacttcccgttccgcaagtaaggtagggttactaaatggctaagcaatcaatgaaagcacgcgaagtaaaacgcgtagctttagctgataaatacttcgcgaaacgcgctgaactgaaagcgatcatctctgatgtgaacgcaaccgacgaagatcgttggaatgcggttcttaagctgcagactctgccgcgtgattccagcccgtcacgtcagcgtaaccgctgccgtcaaactggtcgtccgcacgctttcctgcggaagttcgggttgagccgtattaaggtccgtgaagccgctatgcgcggtgaaattccgggtctgaaaaaggctagctggtaattgtcaccaattgaatcacgggagtaaagacagatgagcatgcaagatccgatcgcggatatgctgacccgtatccgtaacggtcaggccgcgaacaaagctgcggtcaccatgccttcctctaagctgaaagtggcaattgccaacgtgctgaaggaagaaggttttattgaagattttaaagttgaaggcgacaccaagccggaactggaactgactcttaagtatttccagggtaaagctgttgtagaaagcattcagcgtgtcagccgcccaggcctgcgcatctacaaacgtaaagatgagctgccgaaagttatggccggtctgggtatcgcagttgtttctacctctaaaggtgttatgacagatcgtgcagcgcgccaggctggtcttggtggcgaaattatctgctacgtagcctaatcggaggaaaaaatgtctcgtgttgctaaagcaccggtcgttgttcctgccggcgttgatgtcaaaatcaacggtcaggttattacgatcaaaggtaaaaacggcgagctgactcgtactctcaacgatgctgttgaagttaaacatgcagataatgcactgaccttcggtccgcgtgatggttacgcagacggttgggcacaggctggtaccgcgcgtgccctgctgaactcaatggttatcggtgttaccgaaggcttcactaagaagctgcagctggttggtgtaggttatcgtgcagcggttaaagggaatgtagtaaacctgtctttaggtttctctcacccggttgaccatcagctgccggcaggtatcactgctgaatgtccgactcaaactgaaatcgtgctgaaaggcgctgataagcaggtgatcggccaggttgcagcagatctgcgcgcctaccgtcgtcctgagccttacaaaggcaagggtgttcgttacgccgacgaagtcgtgcgtaccaaagaggctaagaagaagtaaggtaacactatggataagaaatctgctcgtatccgtcgtgcgacccgcgcacgccgcaagctcaaagagctgggcgcaactcgcctggtggtacatcgtaccccgcgtcatatttacgcacaggtaattgcaccgaacggttctgaagttctggtagctgcttctactgtagaaaaagctatcgctgaacaactgaagtacaccggtaacaaagatgcggctgcagctgtgggtaaagctgtcgctgaacgcgctctggaaaaaggcatcaaagatgtgtcctttgaccgttccgggttccaatatcatggtcgtgtccaggcactggcagatgctgcccgtgaagctggccttcagttctaaggtagaggtgtaagatggctcacatcgaaaaacaagctggcgaactgcaggaaaagctgatcgcggtaaaccgcgtatctaaaaccgttaaaggtggtcgtattttctccttcacagctctgactgtagtaggcgatggtaacggtcgcgtaggttttggttacggtaaagcgcgtgaagttccagcagcgatccagaaagcgatggaaaaagcccgtcgcaatatgattaacgtcgcgctgaacaacggcaccctgcagcacccggttaaaggtgttcacacggggtctcgtgtattcatgcagccagcttccgaaggtaccggtatcatcgccggtggtgcaatgcgcgccgttctggaagttgctggggttcataacgttctggctaaagcatacggttccaccaacccgatcaacgtggttcgtgcaactattgatggcctggaaaatatgaattctccagaaatggtcgctgccaagcgtggtaaatccgttgaagaaattctggggaaataaaccatggcaaagactattaaaattactcaaacccgcagtgcaatcggtcgtctgccgaaacacaaggcaacgctgcttggcctgggtctgcgtcgtattggccacaccgtagagcgcgaggatactcctgctgttcgtggtatggtcaacgcggtttccttcatggttaaagttgaggagtaagagatgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgcaaagcagcgattacagccgaagttcgtctgtctgacctggcgaaagtagaaggcggcgttgtagacctgaacacgctgaaagcggcaaacattatcggtatccagatcgagttcgcgaaagtgatcctggctggcgaagtcactactccggtaactgttcgtggcctgcgtgttactaaaggcgctcgtgctgctatcgaagctgctggcggtaaaatcgaggaataagtagcagatggctaaacaaccgggattagattttcaaagtgccaaaggtggcttaggtgagctgaaacgcagactgctgtttgttatcggcgcgctgattgtgttccgtattggctcttttattccgatccctggtattgatgccgctgtacttgccaaactgcttgagcaacagcgaggcaccatcattgaaatgtttaacatgttctctggtggtgctctcagccgtgcttctatctttgccctggggatcatgccgtatatttcggcgtcgatcattatccagctgttgacggtggttcatccaacgctcgcagaaattaagaaagaaggggagtctggtcgtcgtaagatcagccagtacacccgttacggtactctggtgctggcgatattccagtcgatcggtattgctaccggtttgccgaatatgcctggtatgcagggcctggtgatgaatccaggctttgcattctatttcaccgctgttgtaagtctggttacagggaccatgttcctgatgtggctcggcgaacagattactgagcgcggtatcggtaacggtatctcaatcatcatcttcgctggtatcgttgcgggactcccgccagccattgcccatactatcgagcaagcgcgtcaaggcgacctgcacttcctcgtgttgctgttggttgcagtattagtatttgcagtgacgttctttgtagtattcgttgaacgtggtcaacgccgtattgtggtaaactacgccaaacgtcagcaaggtcgtcgtgtctatgctgcacagagcacacatttaccgctgaaagtgaatatggcgggggtaatcccggcaatcttcgcttccagtattattctgttcccggcgaccatagcgtcatggttcgggggcggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtaatgacccacctgaccctggttggtgcgctgtatattacctttatctgcctgatcccggagttcatgcgtgatgcaatgaaagtgccgttctacttcggtgggacctcactgcttatcgttgttgtcgtgattatggactttatggctcaagtgcaaactctgatgatgtccagtcagtatgagtctgcattgaagaaggcgaacctgaaaggctacggccgttaattggtcgcctgagaagttacggagagtaaaaatgaaagttcgtgcttccgtcaagaaattatgccgtaactgcaaaatcgttaagcgtgatggtgtcatccgtgtgatttgcagtgccgagccgaagcataaacagcgccaaggctgattttttcgcatatttttcttgcaaagttgggttgagctggctagattagccagccaatcttttgtatgtctgtacgtttccatttgagtatcctgaaaacgggcttttcagcatggtacgtacatattaaatagtaggagtgcatagtggcccgtatagcaggcattaacattcctgatcagaaacacgccgtgatcgcgttaacttcgatctacggtgtcggcaagacccgttctaaagccatcctggctgcagcgggtatcgctgaaaatgttaagatcagtgagctgtctgaagaacaaatcgacacgctgcgtgacgaagttgccaaatttgtcgttgaaggtgatctgcgccgtgaaatcagcatgagcatcaagcgcctgatggatcttggttgctatcgcggtttgcgtcatcgtcgtggtctcccggttcgcggtcagcgtaccaagaccaacgctcgtacccgtaagggtccgtgcaaaccgatcaagaaataatcggggtgattgaataatggcaaaggcaccagtttgcgcacgtaaacgtgtaagaaaacaagtctctgacggcgtggctcatatccatgcttctttcaacaacaccatcgtgactattaccgatcgtcagggtaatgcgctgggttgggcaacagccggtggttccggtttccgtggttctcgcaaatccactccgtttgcagctcaggttgcagcagagcgttgcgctgacgccgtgaaagaatacggtatcaagaatctggaagttatggttaaaggtccgggtccaggccgcgaatctactattcgtgctctgaacgccgctggtttccgcatcactaatattactgatgtgactccgatccctcataacggttgtcgtccgccgaaaaaacgtcgcgtataacgcttcgttttccaggttagttggagaaagaaaatggcaagatatttgggtcctaagctcaagctgagccgtcgtgagggcaccgacttattccttaagtctggcgttcgcgcgatcgataccaagtgtaaaattggacaagctcctggccagcacggtgcgcgtaagccgcgtctgtctgactatggtgtgcagttgcgtgaaaagcaaaaagttcgccgcatttacggtgtgctggagcgtcagttccgtaactactacaaagaagcagcacgtctgaaaggcaacaccggtgaaaacctgttggctctgctggaaggtcgtctggacaacgttgtataccgtatgggcttcggcgccactcgtgcagaagcacgtcagctggttagccataaagcaattatggtaaacggtcgtgttgttaacatcgcttcttatcaggttagtccgaatgacgttgttagcattcgtgagaaagcgaagaagcagtctcgcgtgaaagccgctctggagctggctgagcagcgtgaaaagccaacctggctggaagttgatgctggcaagatggaaggtacgtacaagcgtaagcctgagcgttctgatctgtctgcggacattaacgaacacctgatcgtcgagctttactccaagtaaagcttagtaccaaagagaggacacaatgcagggttctgtgacagagtttctaaaaccgcgcctggtagatatcgagcaagtgagttcgacgcacgccaaggtgacccttgagcctttagagcgtggcttcggccatactctgggtaacgcactgcgccgtattctgctctcatcgatgccgggttgcgcggtgaccgaggttgagattgatggtgtactacatgagtacagcaccaaagaaggcgttcaggaagacatcctggaaatcctgctcaacctgaaagggctggcggtgagagttcagggtaaagatgaagttattcttaccttgaataaatctggcattggccctgtgactgcagccgatatcacccatgatggggatgtcgaaatcgtcaagccgcagcacgtgatctgccacctgaccgatgaaaacgcgtctattagtatgcgtatcaaagttcagcgcggtcgtggttatgtgccggcttctacccgaattcattcggaagaagatgagcgcccaatcggccgtctgctggtcgacgcctgctacagccctgtagagcgtattgcctacaatgttgaagcagcgcgtgtagaacagcgtaccgacctggacaagctggtcatcgaaatggaaaccaacggcacaatcgatcctgaagaggcgattcgtcgtgcggcaaccatcctggctgaacaactggaagctttcgttgatttacgtgatgtacgtcaaccggaagtgaaagaagagaaaccagaattcgatccgatcctgctgcgccctgttgacgatctggaattgactgtccgctctgctaactgcctcaaggcagaagctatccactatatcggtgatctggtacagcgtaccgaggttgagcttcttaagacgcctaacctgggtaaaaaatctcttaccgagattaaagacgtgctggcttcccgtggactgtctctgggtatgcgcctggaaaactggccaccggcaagcatcgctgacgagtaaccggatcacaggttaaggttttactgagaaggataaggtcatgcgccatcgtaagagtggtcgtcaactgaaccgcaacagcagccatcgccaggctatgttccgcaacatggcaggttcactggttcgtcatgaaatcatcaagacgaccctgcctaaagcgaaagagctgcgtcgcgtagttgagccgctgattactcttgccaagactgatagcgttgctaatcgtcgtctggcattcgcccgtactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgttcagagaaaacagaagctgctgcagagtaatctgtagtaacgtaaaaaacccgcttcggcgggtttttttatatcctcctgaaccccacatatctacaataattgtattcttttcgttcaatccctggagcgacgtatgtggttacttgaccagtgggcagagcgtcatattatcgaggcacagcgtaaaggcgagtttgataatctgcctggccgcggcgaaccgcttattctggatgatgattctcatgtgccagcggaacttcgtgcgggttatcgcttactgaagaatgcgggctgtcttccccctgaactggagcagcgcagagacgctattcagttacttgatatcctcaacagtatccgggaagatgaccctcaataccatcaggttagtcgccagctctcgctgcttgaactaaaacttcggcaggctgggttgagtaccgattttttacacggtgagtatgcagaaaaactgctgcataaaatcaacgataattaacggagcttgtatgtatcgcattggtgagctggcaaagctggcagacgtaacgcctgataccattcgctactatgaaaaacagcagatgatggatcatgaggtacgtactgaaggcgggtttcgtctgtataccgaaaacgatctgcagcgtctcaagtttattcgttatgcgcggcagttgggtttcacgcttgagtcgatccgcgaacttttatcgatcagaattgatcctgagcaccatacctgtcaggagtcaaaaagtattgtgcaagaacgattgcaggaggttgaagccaggattgcggaactgcaaacgatgcagcgttcgttacaaaggcttaatgatgcttgttgcggaacggcccacagtagcgtctattgttccattctggaagccctggaacagggggccagtggggcgaaatcagtatgttgatttattgaaccggcgggactacactcgcgccgtataatttatacaaacgggagatattatgagtcgttatcaacataagaaagggcagataaaggacaatgccatcgaggcattgttacacgatccccttttcaggcaacgcgttgaaaaaaataagaaaggcaaaggaagttatctgcgtaaaggtaaacacggtaaccgggggaactgggaggccagtggcaagaaagtaagtgacttttttaccactggccttctgcttattaagaacggttattttgttctttcagcagatcgcggatttcgcccaataacacttcctctttagaaggcgcgggcggagctgccggctcttctgcttttttacggttgagtctgttgataagcttaatggcaacaaagatagcaaacgccacaatcacaaaatcaaatacgttctggataaacacgccgtaatgcatgacgaccgccggaatatctccctgcgcttcgcgtaacgtaaaagcaaattgtttaaagtcgatcccgccgattaacaatcccaacggcggcataatgatatcggcaaccagtgaagaaacaatcttaccgaatgccgcgccaataatgacacccactgccaaatccacaacattcccgcgcatcgcgaattcgcggaattctttaataaaactcatttttattctccctatgcagctgacgttataagtttaacaaatgctaaggcattttccatttacggcttctgtttagcgaaataaattaaaccttgataaataaagggaattaaaaagggcgctgaatgagcgccccttaaattagaggaagaaaggacttggctggaacagacgttcgacgtcggtaataaactttttatcggtcaaaaacataatgacgtgatcgccttgttcaatgcgcaaattgtcattagcaatcatgacatcattaccgcgaacgaccgcgccaataatggtgcctggcggcagttttatttcgtcaatgacgcggccaaccacgcgggaagtgctttcatcgccgtgcgcgacggcttcgatggcttcggcaaccccgcgacgtagtgaggaaacgccgacgatatctgctttacgcacatggctcagtaatgcagagatggtggcctgctgcggagaaatcgcaatatctataacgctaccctgcacaagatcgacataagctcgacgctgaatcagcaccatcacttttttggcgcccatccgcttagccaacatcgcggacatgatattggcttcgtcatcgttagtgactgcgataaagagatcgacctgatcaatatgctcctccgccagcaattcctgatcggaagcgtcgccaaaaaagacgatcgtgttttgcagcttctcagccagttctgcggcgcgttgttgatcgcgttcgatcaatttaacgctatagtctttttccagacgccttgccagcccggcgccgatattgccgccgcccaccagcatgatgcgcttgtagggtttttccagacgctgtaattcgctcattactgcacggatatgctgtgaagccgcaataaagaagacttcatcccctgcttccacgatagtcgagccctgaggacggattggtctgtcatgacggaaaattgcggcaacgcgggtatcgatatgcggcatatgctctcgcattgtcgagagcgcgttacctattagtggaccgccatagtaggcttttactactgccagactgactttcccttcggcaaagtttacaacctgtaatgctcccggatactcgatcagacgataaatattatcgataaccaactgctccggcgcgatcagatgatcaatcggaaccgcttcagaatgaaagagtttatccgcatcgcgaacatagtccggggagcgaatgcgggcgatacggtttggggtgttgaagagtgaataggctacctgacaggcaaccatattagtttcatctgaactggtgacagcgaccagcatatccgcatcgtcagcgcccgcttcgcgcaacacgcggggatgcgaaccatgcccctgaactacgcgtagatcgaacttatcttgcaaactgcgtaatcgttcgccgttggtatcaaccaccgtgatgtcgttgttttcgccgaccaggttttccgccagtgttccaccaacttgccctgcgcccagtatgataattttcatcagtcgtggcccgttatctcatcacttcttgattagcttagcgtaaaagaacccatcaccttcttcgccgcccggcagattttgctgtcctggctgatcaggtgttcccgtttcgctgagcgcggcatcgggagtgcgttgcaaaaaggctttgatctgatcgcggttttcttccggcagtacggaacaggtggcataaaccagcgtcccgccgggcttcaggcgcggccagacggcatcaagaatttccgcctgtaattgcgccagttccgcgatatcgcgatcgcgacgcagccatttgatatctggatgacggcgaatgacgccggttgcggagcagggcgcatccagcagaatacggtcaaactgctgctcgccgcaccattgggcgggataacgtccatccccttgtttaactgtcgctttcatcccaaggcgctttaggttgtcgtaaacgcgggagagccgttgttcatcaatatcaaccgccaacacgtctgcttcgggggccacttcgagaatatgcgtggttttaccgccgggcgcggcgcacaagtctaaaatgtgctcaccgttctgaggagcgagaaaaaccgcacatccctgcgcagaggcatcctggacagttacccaaccctcagcaaaaccgggtaaagcatgtaccggagctggcgtttccagacgcacagcgtcgggataatcgggatggggatatcccttcatgcctgcgtcttcaagtaagccaagccaaccgtcgcgggtgtggtgtgtacgatttacacgtagccacataggtggacgctggttattcgcttcaataatgcgttgccactgtgtggggtaagcattttgcaaacgctttaccagccaaccgggatgtaaaaagcgcgcatcgctggtcgcaaactcattaagcaacgtttcctgctggcgctggaactggcgcaggacgccgttaattaaccctttcaactgcggacgtttgatggagaccgcgccttcaacggtttcagccagcgccgcatggggagggacgcgggtgtacagcaactgataaaagccgaccataattaagtaatgcactgtacgctgcttgccggtcattggacgagacatcagcttattgatcagccattccagctgtgaaagggtgcgcaggacgccaaagcacagctcctgaagtagcgctttgtctttatcggcgactttttgttgcagcggcgggagcacattacttaatgattgtccctgttcgacgaccagttcaacggcctgtgctgccagactacgtaaattgttttgttttttcatatgtataaaataaaaatgcccggtaacaccgggcgtataaagacgtgaccgtcaggcaaggcggttaccagggataaaccattcccggcgtgaatttaacagatcctgggcgctcatcgcttttttgccggcaggctgaagcgaaagcaaatttaatatccccttgcctgttgcaacctgaatgccctgtttcgtcgcggccagaatggttcccggcagcgactgcgtggcgtcctcaatgacggatgcctgccagacttttaccggctggccgtcgatttccagccagctcattggccacggattaaaggcgcgaatgcaacgctccagctgtgctgcggagagagaccagtcgatacgcgcttcttctttactgagcttttccgcatgagtgaccagcgcttcattctgcgcttcaggcgtcgctgtgccgtccgccagttgttttagtgtggtaattaacccctgtgggccaagttcagccaacttattatacagtgagccactggtatcttctgcggtaatcgggcacgcaagtttatacagcatgtcgccggtatccagccctacatccatctgcataattgtgacgccggtttccgcatcgcctgcccagagtgagcgctgaataggcgccgcgccgcgccagcgtggaagcagcgaaccgtgaacgttgatacatccgagacggggcatatccagcactgcctttgggagaatcagaccatatgctacgacaaccatgacgtcggcatgtaagtcagccaccagatgctggttttcctgaggacgaagcgacacgggctggaaaacgggcaggcctttttcttccgccagcacttttaccgggctgggcatcaactttttgccgcgacctgctggacgatcgggttgggtaaatacgccgacaatgttatgtccagaagttaacagcgcgtcgagatgacgcgctgcaaagtcaggtgtacccgcaaaaataatacgtagtgaatctgacacgttggttcttgtcctttaagcccgggcgttcaggcggtcgagtttttctactttctgacgaatacgttgttgcttcagcggcgacaaataatcgataaacagtttaccgaccaggtgatccatctcatgctgaatgcagattgccagcaaaccatccgcttcaagctcaaacgggttgccgttgcgatccagcgcgcggattttcactttctcggcgcgcggcactaaagcgcgctgttccgggatcgacagacagccttcttctatacccgtttcgccacttttctccagcaattccgggttaatgagtaccaggcgctcgtcgcggttttccgaaacgtcaatcacgatgatccgctggtggatatcgacctgcgttgcggccagaccgataccttcttccgcgtacatcgtttcgaacatatcatcgacgatacgctgaatttctgcattcacttcttcaaccggctttgcgactttgcgaaggcgctcgtccggaatatgtaacacttgcaaaactgacataattatccagagttgtgttcaggagttgaaaagattattacctctattctagacaaatccccacctgattgacagcatcagtgaccaatcgcaaagattgttcagactgcttgtggcaggggagggaaaggatggcccgtaccgaaatttggttacgtttaatgtacgtcggcgacctttatggcgaggcgatgttgaacatggcgaattcgcttattcgccagcctcagataaatcgcacgcaccttcaggaggctggtcttactgcgcggcaagctgaacgttttttacagcttccagcaggtgtgcttgatgagacgttacgctggcttgaactaccgcagcaccattttctgtgtgcggatagtgagatttatcctcctcaactgcgtgctattgacgattatcccggcgctatttttattgacggcgatcctgcctgtctgcatacctgccaacttgccgtcgtcgggagccggagccactcctggtatggagaacgctggggacgtctgctttgcgaaagccttgcgaaaagcggtttgacgatcaccagcggccttgcccgaggaattgatggcgtagcacacaacgccgcgatgagtatggggggaaaaagtgtagcggtgttagggaatggcttggcaaagatttatcctcgccgacatgccatgctggctgaaaacttgattgccactggcggcgcagtggtctcagaatttccgctttcaacgcctccgctatcgcaaaattttcctcgcagaaaccgtatcatcagcggactgagcaaaggcgtactggtgattgaggcggcgttgcgcagcggttcgttggtgacggcgcgctgcgcgcttgaacaggggcgggacgtttttgcattaccaggccctatcggtagtccgggaagcgaaggcacgcactggttaattaaacaaggggccacgcttgtgacgacgccggaggatattctggaaaatttgcaatacggcttacactggttgccaactacggcggaaaattcactttattcactaaatcaggatgaggcggcattgccatttcctgagctcctggctaacgtaggagatgaggtaacacctgttgacgtcgtcgctgaacgtgccggccaacctgtgccagcggtagtggctcagctactcgaactggagttagcaggatggatcgcagctgtacccggcggctatgtccgattaaggagggcaagccatgttcgacgtactaatgtatttgtttgaaacatacatccataacgaagccgagctgcgcgtggatcaggacagactggagcgtgatctcaccgacgctgggtttgatcgcgaagacatctacaatgcgctgctgtggctggaaaaactcgctgactatcaggatggcctcgcggaacccatgcaacttgcttccgaccctctttcaatgcgcatttatacggttgaagaatgtgaaaggcttgatgccagttgccgggggttcctgttattccttgagcagattcaggtgctaaacctcgaaacacgagaaatggtgattgagcgtgtgctggcgctggataccgcagagtttgacctggaagacttgaaatgggttattttgatggtgttattcaacattccgggctgtgaaaacgcctatcagcaaatggaagaattactctttgaggtaaatgaaggtatgctgcattgataggtgttaatgctgcatgagtgaatatggctaaatcagcactgttttcggtgcgtaaaaatgagccctgcccgcagtgcggggccgaactggtaattcgttccgggaaacatggtccgtttctcggctgttctcgctatccggaatgcgattacgttcgtccgctgaaaagtcaggcggacggacatatcgttaaaattctggaggggcaactgtgtcctgagtgtggcgccgtactggtgctgcgtcaggggcgctttggcatgttcatcggatgcagtcagtatccgcaatgtgaacatacagtggttattgataaaccggatgaaacggcgattgcctgtccagcctgccagcaaggacatttggtccagcgccgttctcgttacggtaaaatctttcattcctgcgatcgctacccggaatgtcagttcgtcattaacttcacaccggttgcgggggaatgccccgagtgccattattcgctactcatcgaaaagaaaaccgcgcagggcgtgaagcgcttttgcgccagtaaacaatgtggaaagccggttccggtggaataaacaagtgaataataacctgccaacaggatctagcgccgcggtggtagatctcctgaataaagaaaatgtcatcgcttatccaacagaagccgttttcggcgtcggctgcgatcccgatagtgaaacagccgttacgcgcctgctggcgttaaaacaacggcccgtcgataagggactcattttgattgccgccagctttgagcagttaaaaccttatattgatgacagcatacttaccgccgcacagcgtaaagcggtatttgattgctggcccgggccggtaacgtttgtttttcctgcgcccgcgacaacgccgcggtggctcacgggacgttttgattccctggccgttcgtgttaccaaccacccgctggtggtcgcgctatgcaatgcgtatggcaaaccgctggtttccaccagcgccaatctgagcggattaccgccatgccgtaccgttgaagaggtgcgtgcgcaatttggcgatgattttccggtggttgaaggcgcaacgggtgggcgtttaaatccttcagaaatccgcgatgctctgacgggcgaactatttcgacaggggtaatatgatggaagcctatgctgtttttggaaatccgattgcgcacagcaaatcgccatttattcatcagcaatttgctcagcagctagatattgttcacccctatggtcgcgtgctggcccccattaataatttcattaatacgcttgatgcctttttcgcggcagggggaaaaggcgcaaacatcacagtaccttttaaagaggaggcgtttgcgcgttcggatgagttaacggaacgagcatcgctggcgggagccgtcaatacattaaaacggctggaagatggtcgtttgcttggcgacaatactgacggtatcggtttattaagcgatctcgaacgtttaaattttatccgcccaggattgcgtattttgctgattggcgcgggcggcgcatcccggggcgtgctgttacccctgctttctttggattgtgcggtcactatcactaaccgtacagcttcacgtgccgaagcgttggcgaaaatctttgctcataccggcagcgttcatgctatggatatggacaagctggatggttgtgagtttgacctgattattaatgcgacctccagcggcatacggggcgaaatcccggcgattccggcgtcacttattcatccttccctctgttgctatgacatgttctatcaaaaagggaatacgccatttctctcctggtgtgtacaacagggcgcgaaacgctacgcagatgggctgggaatgctggtggggcaggctgcacatgccgttttgctttggcacggtgtattaccgcaggtcgagccagtgattaagctgctacagcaggaattattagcgtgaaccaggccatacaattccctgaccgcgaagaatgggatactgccgccagcgctatcatctttcccgccctggtcaatgggatgcaaatcacgtgtgcgataaaaaaagatgtactggcgtatcgctttggtggagaaacagcggagcaatggctggccatttttcgtgagtatcgctgggacctggaagaagaggctgaagcattaatcctggcccagcaggaagacgatcacggttggatatggttatcctgagaaagatagtcgtctttccattttacatagttattggcggagtactgcaggcccgatctctcagcatcgctcagggggcggatctgttttaccggactgccaagatataaatagccgctttccagccgtttgtgctgcggcaccaggcttcccgcgccaatcattacgtcatcttctattatcgcgccatccagcacaatggagcccataccgaccagtacgcggttaccgatggtacagccgtgcagcataactttatggccaacggtaacatcttcgccaatgattaatgggttgccgtgtggattggatggagacttgtgggttacgtgaagaacgctgccatcctgaatgttcgtacgagcccctatcgcaacgtaattcacatcgccgcgaatcaccacaagcggccagatcccgacatcatccgccagacggacatcgccaataaccacgctgctggtatcgatcatcacgcgctgaccgatttcaggaaaaagatccttataaggacgtaatgtgtcagacatgtctacctcatcataaatgaatagtcatgaagactttggttgctttaacggcgttgtgcaaggggagatagcatcaaaaaatcgccactttgcgcaggaatggagcgaaagggatgaaaaatcaacaaacagaaaaaagatccaaaaaacgcttgtgcaaaaaaatgggatccctataatgcgcctccatcgacacggcggatgtgaatcacttcacacaaacagccggtcggttgaagagaaaaatcctgaaattcagggttgactctgaaagaggaaagcgtaatatacgccacctcgcgacggtgagctgaaagccgcgtcgcacctgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttaccttaaagaagcgtactttgcagtgctcacacagattgtctgatgaaaagtgaatagcaaggcgtcttgcgaagcagactgatacgtccccttcgtctagaggcccaggacaccgccctttcacggcggtaacaggggttcgaatcccctaggggacgccacttgcgcggtaatgtgtgaaaggcgttgccatcagtatctcaaaactgacttacgagtcacgtttgagatatttgctctttaaaaatctggatcaagctgaaaattgaaacacagaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatacgcatcctttgctgaggagacggttaacggagcgaaagcgacgttcaacctcaaaagaagcagagggggcttagtggtggggtgactgcgtaccttttgtataatgggtcagcgacttatattctgtagcaaggttaactgtataggggagccggagggaaaccgagtcttaaccgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaatgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacaccgtgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtatgtgttccaggtaaatccggttcactttaacactgaggcgtgacgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcacggagctgaagtcagccgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagactttaggtctcctgaaggaacgttgaagacgacgacgttgataggccgggtgtgtaagcgcagcgatgcgttgagctaaccggtactaatgaaccgtgaggcttaaccttacaacgccgaagatgttttggcggatgagagacgattttcagcactgattccggattttcgggaacgaaagataaaagattcgtttccggcaacagaatttgcctggcggcactagcgcggtggtcccacctgaccccatgccgaactcagaagtgaaacgccgtagcgccgatggtagtgtggggtctccccatgcgagagtagggaactgccaggcatcaaattaagcaaaaggctcagtcgaaagactgggccttttgttttatctgtggtctgccggtgagcactctcctgaggaggacaaatccgccgggagcggatttgaacgttgcgcagtaacggcccgtagggtggcgggcagcacgcccgccataaactgccaggcatcagacaagtgaagaagcccatcctgacggacgggcttttttgcgtgtgtggtaactgataaaaatgtaggcctgataagcgcagcgccatcaggcaacctgcaccgccggatggcggcttcgccttatccggcctgcatgcacttatcaggcagcgccactactcacggataaattaaattcaacaatggatacggtttcccaagatcgtcgacctccgaacgtcccgtcaccttgaatcccattttcttataaaattcaacagcttgtgtattttgctcgttaacattggttgtcaatcccggcgccagtgttaatgcatgttcaaccagcatcttaccgataccctgaccacgcacgtccggatcgataaacagagcatccatatgctcaccggtaagcagcataaaccctaccggctcatcctgatcggtcacggcaacccatagtggcgcttctggcagaaaatcgctcaccagttcttccagttcggcccgataagcgtttgacagaaaatcgtgcgtggcatcgactgagcgacgccagatcgcaatcagtttttccccttcctcacgccttgaacgacgaatgttaatcatcatcttcactccttttttgcttacttctattctaatgcaaatgctgtcgtgaaactttctcaccttgaacttgcagactcgacattcgcctgatttctgagtatcttcagctatctggatgtctaaacgtttaaacgtatatcgtgaggttatcaggttatgccgattcgcgtgctggacgagctacccgccgtcaattttttacgtgaggagaatgtcttcgtcatgacgacttctcgcgcatcaggtcaggaaattcgcccgctaaaggtacttattcttaacctgatgccgaagaagattgaaacggaaaatcagtttctgcgtttgctatcgaactcgccattgcaggtcgatattcaactactgcggatagatgcccgcgagtcgaggaacacgccagccgagcatctgaacaacttttactgtaacttcgacgatatctgcgatcagaactttgatgggcttatcgtgaccggagcgccgctgggtctggtggagtttaatgacgtggcttactggccgcagattaggcaggtgctggaatgggcgaaagatcacgttacttcgacgctatttgtctgttgggccgttcaggccgcactcaatattctttatggtatccctaagcagacccgtacagataaactttccggcgtctatgaacatcacattcttcatccacatgctctgttaacgcgtggttttgatgattcgtttcttgcgccacactcacgctatgccgatttcccggcggcgctaatacgggattatacggatcttgaaattctggccgaaacagaagaaggggatgcgtacctgtttgccagcaaagataaacgtattgcgtttgtcaccggtcatcctgaatatgacgctcatacgttagcgggggaatattttcgtgacgttgaggccgggttaaatccggagattccgtacaactatttcccgaaaaacgatccgcaaagcataccgcgcacaacctggcgcagccacggcaatttactgtttactaactggctcaactattatgtctactagattacgccatatgatctgcgtcacatgaatccaaccctggattaatcttctgcttctgacaatcctaaagcgtttcagcatgttgaatcaggcaccttcgggtgccttttttatttccgaaacgcacctcatcatgtaattaaatttaatttatattgttatcaataggttaatgtgtaattaaattaaaaatggaaattgtttttgattttgaaatttaattgagtagtcttagttgtgttgaacgaaaagcgcacagtgatccttcgttcgcattggggatgtatctggatcaacaacgaggagctgcatgatgaatccacaggcaaccacaactgatgaattaacctttaccaggccgcaaggcgagctggaaaagcaagtcctgaccgctgaggcagtcgagtttttgacggagttagtcacccgttttacgccaaaacgcaataaactcctggctgcacgtatccagcaacagcaggatattgataacggtaagttgcctgattttatttcggaaaccacttccattagagaaagtaattggcagattcgtggtattccggcggatttacaggatcgccgagtagaaattaccgggccggttgaacgtaaaatggtgattaatgccctgaacgcaaatgtgaaagtgtttatggcggattttgaagactcgctggcgccggactggaataaagttattgatggtcaaatcaacctgcgtgatgcggtgaacggcaccattagctataccaacgaagccggaaaaatctatcagctcaagcccgatccggccgtattgatttgtcgtgtacgcggtctacatctgccagaaaaacatgttacctggcggggggaagccattcccggcagcctgtttgattttgctctgtactttttccacaactacaaagcgctgctcgctaaaggtagcggcccgtatttttacctgccgaaaacgcaagcctggcaggaggcagcctggtggagtgaagttttcagctacgccgaagaccgcttcaatctaccgcgcggtacgatcaaagcgaccctgttgattgaaacgctgcctgctgttttccagatggatgagattcttcatgcgttgcgtgatcatatcgtcggtctcaactgtggtcgctgggattatattttcagctatatcaaaacgttgaaaaatcacccggatcgcgtcctgccggacaggcaggtggtaacgatggacaaaccgtttctgagtgcctactcgcgcctgctgatcaaaacctgtcacaagcgcggcgcgttcgcgatgggcggtatggcggcgtttatcccgagcaaagacgttgaacgcaataatcaggtccttgccaaagtgaaagcggataaagcgctggaagcgaacaacggccacgacggcacgtggattgcgcatcccgggttggcggatacggcaatggccgtctttaacgaggtactgggcgagtacaaaaatcagctgttcattacccgtgatgaagatgcgccgattaccgctgagcagttactggagccatgtgaaggcgaacgcacagaagcgggaatgcgcgccaatattcgcgtggcagtgcagtacattgaagcgtggatccccggcaatggctgtgtaccgatttacggtctgatggaggatgccgcgacggcggaaatctcacgaacctctatctggcagtggattcaccatgagaaaacactgagcaatggaaaacccgtaacgaaagcgcttttccgcgaaatgttggcggaagagatgcgggtaatccaggacgaactgggcgagcaccgctacagcagcgggcgcttcgacgatgccgcacgtctgatggagcaaatcaccacatcagatgacttaatcgacttcctcaccctgccgggctatcgcttactggcttaattcaccacataacaatatggagcatctgcacatgaaaacccgtactcaacaaatcgaagaattacagaaagagtggacacaaccgcgctgggaaggcatcacccgcccgtacagcgcggaggaggtggtgaaattacgcggctcggttaacccggaatgcacgctggcgcagctcggcgccgcgaaaatgtggcggctgttgcacggtgaagcgaaaaaaggctatatcaacagcctgggcgcgctgactggcggtcaggcgctgcagcaggcgaaagccggtattgaggcgatttatctttcaggctggcaggtggtggcagatgccaacctggcatccagcatgtatccggatcaatcgttgtacccggcaaactctgttccggcggtagtggatcggatcaacaacactttccgtcgtgcagatcagatccagtgggcatccggtattgaacccaacgatccgcgctatgtggattacttcctgccgatcgttgctgatgcggaagccggttttggcggcgttctgaatgccttcgaactgatgaaatcgatgattgaagccggtgcagcggccgttcacttcgaagatcagctggcgtcggtgaagaaatgcggccatatgggcggcaaggtgctggtccccacgcaggaggcgattcagaaactggttgctgcgcgtctggccgctgatgtgatgggcgtcccgacgctggtgattgcgcgtaccgatgcggatgcggcagatctgatcacctccgactgcgatccctatgacagcggttttattaccggcgaacgcaccagcgaaggtttttaccgcacccatgcgggcattgagcaggcgatcagccgcggtctggcgtatgccccgtatgccgatctggtatggtgcgaaacttctacgccggatctcgaactggcgcgtcgttttgccgatgctatccacgcgaagtatccgggcaaactgctggcctataactgttcgccatccttcaactggcagaagaatctggacgacaagaccattgccagcttccagcagcagttgtcggacatgggttacaaataccagtttattaccctggcgggcatccacagcatgtggttcaacatgttcgacctggcgcatgcatacgctcagggtgagggcatgaaacactatgttgagaaggttcaacaacccgagttcgccgcagcgaaagacggttacacctttgtttcccaccagcaggaagtgggtactggttacttcgacaaagtcaccaccattattcagggcggcgcgtcatccgttaccgcgttaacgggttccaccgaagaatcgcagttttgattgatgcccggtggcgctgcgcttaccgggcctacagatagcgtaggccggataagcgaacgcgccatccggcatgatgtggtgccggatgagggaaaaaatgccgcgtggcctggaattactgattgctcaaaccatcctgcaaggctttgacgcgcagtatggtcgatttctggaagtgacttccggcgcgcagcagcgttttgaacaggccgactggcacgccgtccagcaggcgatgaaaagccgtatccacctctatgatcatcatgtgggtctggtggtggagcaactgcgctgtattaccgatggcaaaagtaccgacgcggatttccttttacgcgttaaagagcattacacccggctgttgccggattacccgcgcttcgagattgcggagagctttttcaactccgtttattgccggttatttgaccaccgctcgttaacacccgagcggttgtttattttcagttcgcaaccggagcgtcgcttccgtactatcccgcgcccgctggccaaagacttctttcccgatcacggttgggagccgctgttgatgcgcatactcagtgacttaccgctgtgtctaccctggcagaataaaagccgggatatccgctatattatcgcgcacctgactgaaacactgggcgaggacgcgctacctcgctgccatgtccaggtggcgaacgagttgttttactgtaataaagcggcctggctggtaggtaaattaaccacacctgacggtacgctgccgtttttattgccgattcatcgcactgatgagggggaactgtttgtcgatacctgcctgaccaccacggcagaagcgagcattgtgtttggttttgcccgctcttattttatggtgtatgcgccgctgcctgccgcgctggttgagtggttgcgtgaaatcctgccgggtaaaaccactgccgaactgtatatggcgattggctgccagaaacatgcgaaaaccgaaagctaccgcgaatatttatgttatctggctgaaagcgatgagaaattcattgaggcgcctggaatccgcggcatggtgatgctggtatttaccctgccaggcttcgaccgggtatttaaaatcattaaagacaaattcgccccgcagaaagagatgtctgccgcccatgtgcgtgcctgttatcaactggtaaaagagcatgatcgcgtcggtcgtatggcggatacccaggagtttgagaatttcgtactggataaacggcaaatcgatccggcgctgatggcgctgttacgacaagaagcgccagagaagattaccgatcttggggaacatatcgtcattcgtcatctctatattgaacgtcgcatggtgccgctcaatatctggctggaacaggtagaaggccagcagttgcgcgatgcgatagaagaatatggtaatgcgattcgccagcttgccgccgctaatattttcctcggcgatatgttgtttaaaaactttggcgttacccgtcatggtcgcgtggtgttctacgactacgatgaaatttgctacatgacggaagtgaatttccgcgatattccgccagcgcgttatccggaagacgaactggccagcgaaccctggtatagcgtctcgccgggtgatgttttcccggaggagtttcgccactggctgtgtgccgatccgcgtatcgggccattgtttgaagagatgcatgccgacctgtttcgcgccgattactggcgcgcgctacagacgcgtattaaagaagggcatgtagaagatgtgtatgcctatcgtcgccgccagcgctttagcgtgcgttatgaaaccgaccgtaggccggataaggcctttgcgccgccatccggcaatgtacgccgtgcctgatggcgctgcgcttatcaggcctacaaatcagttccaacccttgcttatctaaacccaccataggccagcgtcacctctttcgccgctttaatcaccatggcgccaagttcggtgacgcgatcgtcggtaatgcgtgagcaggggccggaaatagagagggccgcaaacggttcgcggtgttcgtcataaatacacgaggccacgcagcgcagaccgagcgcatgttcttcgtcgtcaaaggaatagccgcgcttgcgtgtttgggcgaggtcatctttcagatgcagcggcgacaccagcgtcgcatgggtataagcgtgcaaccccttgcggtgcagcagactggtaacctgttcctcactgagctgtgataaaaacgccttgcccgcgccagaggcgtgcatgggcagcttgccgccaataggggcggacatgcgcatcaattgtgtgcactgcacctggtcgataataatagcctgatggtcgctctggtcgagtacggcaaggtttaccgtttcgccggagtcctccatcagcttgcgcaaaatcggatggacaatcgccagcagattacggctctgtaagaagctgctaccgacgataaacgcgtgtgcgcctacggcccagtggcccagctcaccaacctggcggacaaaaccctgttgctgcatggtggtgagtagacggtgagtcgtggaattaggcaaacccgcctgttgcgccagttcggtcagcgcgacgctgccgttggactcggcaatccactccagcagcttcagaccgcgagttaaagactgaacctgcccggttacgggtgcagtggtagcggcaggttttctcccgcgttttgcgggaacaggggcaaccatggcagactcctttttctgtatcgtggaaatcattttcgttttattcaattataatgcaagagttcctgaactgatcggatgagtgacatcacaggatgcccgatggcgctgcgcttatcaggcctacgctttgggagccgccaaagtaatttgtagactgataaggcgcttgcgccgccatccggcaaagcgacagaagtgggtggcaagctgaacatgtctcatgttgcccgttgttctcttttccgccagcacgctttgtgccagtatggctcgttacgtggagcgttgtcgggagcgagtgtgagcagcaaagttgaacaactgcgtgcgcagttaaatgaacgtattctggtgctggacggcggtatgggcaccatgatccagagctatcgtctacatgaagaagatttccgcggggagcgctttgccgactggccctgcgacctgaaaggcaacaatgacctgctggtcctcagcaagccggaggtgatcgccgctatccacaacgcctactttgaggctggcgcggatatcatcgaaaccaacacctttaactcgacaaccattgcgatggcggattaccggatggaatccctgtcggcggaaattaactatgcggcggccaaactggcgcgcgcctgcgccgatgaatggacggcgcgaacaccagaaaaaccacgctttgttgcgggcgtgcttggtccaactaaccgcacggcctccatttcgccggacgtcaacgacccggcgtttcgtaatatcaccttcgatcagctggtggcggcctaccgtgaatccaccaaagcgctggtggaaggcggggcggacctgatcctgattgaaactgtcttcgacaccctcaacgccaaagcggcggtgtttgcggtgaaagaagagtttgaagcgctgggcgttgatctgccgatcatgatttccggcaccatcaccgacgcctctggccgtacgctttccggccagacgaccgaagccttttataactcgctgcgccacgccgaggcgctcacttttggccttaactgcgcgctggggccagatgaactgcgccagtacgtccaggaactgtcgcggattgccgaatgctacgtcaccgcgcacccgaacgccggcctgccgaacgctttcggcgagtacgacctcgacgccgacaccatggcgaaacagattcgcgaatgggcggaagcgggcttcctgaatatcgttggcggctgctgcggcaccacgccggagcatattgcggcgatgagccgcgccgttgccggtttgtcgccgcgccagctgccggatatcccggtggcctgccgcctttccggcctggagccgctgaacattggtgacgatagcctgtttgtcaacgtcggcgaacgtactaacgtcaccggctcggccaaatttaaacgcttgatcaaagaagagaaatacagcgaagcgctggatgtcgcccgtcagcaggtcgaaagcggcgcgcagattattgatatcaatatggatgaggggatgctcgacgccgaagcggcgatggtgcgtttcctcagcctgattgccggtgagccggacattgcccgtgtaccaatcatgattgactcctccaaatgggaggttatcgaaaaagggctgaagtgcattcagggtaaaggcatcgtcaactctatttcgatgaaagagggcgtggaagcctttattcatcatgcgaagttgctacgtcgctacggcgccgcagtggtggtgatggcttttgatgagcaggggcaggccgacacccgcgaacgtaaaatcgagatttgccgccgcgcttacaaaattttgctcgaagaggtaggctttccgccggaagacatcatcttcgacccgaatatcttcgccgtcgccaccggtattgaagagcacaacaactacgcgcaggactttatcggcgcttgtgaagacatcaaacgcgagctgccgcacgcgctgatctccggcggcgtgtctaacgtgtccttctcgtttcgcggcaacgacccggtacgtgaggctatccacgcggtattcctctactacgccatccgcaacggcatggacatgggcatcgtcaacgccgggcaactggcgatttatgacaacctgcctgccgaactgcgcgatgcagttgaagatgtcattcttaaccgtcgcgatgacggcaccgagcgtttgctggatttggcggagaaatatcgcggcagcaaaaccgacgaggctgccagtgcccagcaggcggaatggcgtagctgggacgtgaaaaagcgtctcgaatactcgctggtgaaaggcattaccgagtttatcgaacaggataccgaagaagcccgtcagcaggccgcccgcccgattgaggtgattgaagggccgctgatggacggcatgaacgtggtcggcgacctgttcggcgaagggaaaatgttcctgccgcaggtggtgaaatccgctcgcgtgatgaaacaagcggtggcctacctggagccgtttattgaagccagcaaagaaaaaggctccagcaacggcaagatggtgattgccaccgtgaagggcgatgtgcacgacattggcaagaacattgtcggcgtggtgctgcaatgcaacaactacgaaatcgtcgatcttggcgtgatggtgccagcggagaaaatcctcagaacggcgcgtgaagtgaatgccgatctgattggtctttccgggcttatcaccccgtcgctggacgaaatggtcaacgtggcgaaagagatggagcgtcagggctttactatcccgctactgatcggcggcgcaaccacttcgaaagcgcatacggcggtgaaaatcgagcagaactacagcggtccgacggtctacgtgcagaatgcttcgcgtaccgtgggcgtggtggcggcgctactctccgacacccagcgtgatgactttgtcgcccgtacccgcaaagagtacgaaaccgtgcgtattcagcacgcccgcaaaaaaccgcgcacgccgccggtcacgctggaagcggcgcgcgataatgatctggcatttgattgggaacgctacaccccgccggtagcccaccgtctgggcgtgcaggaggtggaagccagcatcgaaacgctgcgcaactacatcgactggacgccgttctttatgacctggtcgctggccggcaaatacccgcgcattctggaagatgaggtggtgggcgttgaggcgcagcgtctgtttaaagacgccaatgatatgctggataaactgagcgccgagaaactgttgaatccgcgtggcgtggtgggcctgttcccggcgaaccgtgtgggtgacgacatcgaaatctatcgcgacgaaacccgtactcatgttctgacggtcagccaccacctgcgccagcagaccgagaaagttggttttgctaactactgtctggcggattttgtcgcgccgaaactgagcggcaaagcggactacatcggtgctttcgcggtgaccggcggtctgaaggaggatgcgctggcggacgccttcgaagcgcaacacgacgactataacaagatcatggtgaaagcgattgccgaccgtctggcggaagcgtttgccgagtatctgcatgagcgtgtacgtaaggtttactggggatatgcgccgaacgagagcctgagtaacgacgaattaatccgcgaaaactaccaggggattcgcccggcgccgggttatcctgcctgcccggaacataccgaaaaaggcactatctggcagctactggatgtcgaaaaacacaccgggatgaagctcaccgaatctttcgccatgtggcctggcgcgtcggtctccggctggtacttcagccatcctgagagcaaatacttcgcggtagcgcagatccaacgcgatcaggtgacagattatgctttccgtaaaggaatgagcgttgaggacgttgagcggtggctcgcgccgaacctgggttacgatgcggactgattcataaaatcgtcacttttccttacaacatacaaggcactcattgggtgccttgtctctttcttacaattaaacccttatactgaaggaaggctctacgctgaatttgccggatggcggcgtaaacgccttatccagcatgtatggtaagcctggtggcgtgcaacgccaccaggccttaacgctgtgcgccatcaggcaatttatcgcaagtgagcttcaggaaaacgtataacgataaggagaacctgacgccgtgttaactttgctccatctactttctgccgttgcgctgttggtatggggaacacatatcgttcgtactggcgtaatgcgcgtgtttggcgcgcgtctacgcactgtcctcagccgcagcgtggaaaagaaaccgctcgccttttgtgcgggtatcggtgttaccgcgctggtacaaagcagtaacgccaccactttattggtaacgtcgtttgtcgcccaggatcttgtcgccctgacgccagctctggtgattgtgctgggcgccgatgtgggtactgcgctaatggcgcgtattctcacctttgatttgtcgtggctatcgccgctgctgatttttattggcgtgattttctttttgggacgtaagcagtcccgcgccgggcagctgggtcgcgtcggtatcgggcttggcctgattctactggcgctggagctgattgtgcaggcagtgacgccgatcactcaagctaatggcgtgcaggtcattttcgcgtcgctgacgggcgacattatgctggatgcgctgattggcgcgatgttcgctattatcagttattccagcctggcggcggtgttgctgacggcgaccctgacggcggcggggattatatcgttcccggtggcgttgtgcctggtcatcggcgccaatctgggatcgggcctgttggcgatgctcaacaacagcgccgccaatgctgccgcgcgtcgcgtagcgctcggcagcctattgttcaaattgatcggcagcctggtcatcctgccgtttgtccatccgctggcgaatttgatggatgagctaccgctaccgaaatcagagctggtgatctatttccacgttttctataacctggtgcgctgcctggcgatggtgccatttgccgagctgatggcgcgtttttgtaaacgaattattcgtgatgagcctgaactggatacccatctgaagccgaaacatctggatgtcagcgcgctggatacgccaacgctggcgctggctaatgctgcccgtgaggtgttgcgcattggcgatgcgatggaacagatgatggaagggctaaaaaaggtcatgcacggcgaaccgcgtgaagagaaagcgctgcgcaagctggcggatgacgttaacgtgctctacaccgcgattaagctttatctggcgcgaatgccgaaagacgagctggcggcggaggagtcccgccggtgggcggagattattgagatggccctgaacctcgaacaggcgtcggatattatcgagcgaatgggcagtgagattgccgacaagtcgctggcggcgcgtcgggcattttcagaagaaggattgaaagagctggatgcgctttacgatcaactgctcagtaatctgcaactggcgatgtcggtctttttctccggcgatgtcaccagcgcccgtcggttgcgccgcagtaaacatcgcttccgtatacttaatcgccgatgctcacatgcgcatgtcgaccgcctgcaccagcagaacgtgcaaagtattgaaaccagctcgctccatttagggctgctgggcgatatgaagcgtcttaactcactgttctgttcggtcgcctatagcgtactggaacagccggatcaggacgaggaacggggcgagtattaagtgaaatgccggatggcggtgtaaacgtcttccggcctacggaaaacatgcgcgtaggcccgccattcggcattcaatgtggcctgggattaaaagcgatgacccgcttccagcgccacggcctcttcgcccgctttaaacacccaggtggtattcgggccgccgagaaccgcttggccgttgctcacctgaatccagttgccttccggcaaaccaatcactgtcagttccggcgcgaccaccagcagttcgcgaatatgctgctcgcgggtctcgcccttatgaccctccggcaaggcgttagtgaagtgaggattaatttgcagcgggaacagatccagcgcgtcgaaaccgtttggatcgacgatcggcatatcgttggtcgtgcggatagtcgggcaggcaaggttggcgcccgcgctccagccgatatacagcgcgccgcgttttaccctgtccgccaccggcgccagcagcccgcgttcacgcgattctttcagtagctggaaggtatttccgccgccgacaataacgatttccgctttctcaatcgccgcaagcggatcggcgacacgatgaatccctgtgacgtttatccctaatggcgcaagcacctctgcggttttatccgtgtactcgtcccatgtttgcgtgacgccggcaaacggaataaacacggctgagcgtcgaccgttcaactgattcgctatcagcggcagagcgtgttccagccaggctttacccggcagcgtcgagttacttaataaaagcagttccattatttctccacctcatcaggaaatgtcaaaacgtaataatgctaccattatccatttaatgtcttactgatatggctcatgatgttgcgcgtgttacaggcaacgcgcggtcgctaaaagtgacgccaggccagatctgccatctggtatcgcctgaaaaattacaggtataatccgcaaaattatttaacacgtttagagacgaaaatggcaaaactgaccttacaagagcaactgctacaagcgggattagtgaccagcaaaaaaatggccaaagtccaacgcacggctaaaaaatcacgcgttcaggctcgtgaggccagagaagcggtggaagaaaataaaaaggcgcaacttgagcgtgataaacaactcagtgaacagcaaaaacaagcggttttagcgaaagagtttaaagctcaggttaagcaacttattgaaatgaatagaatcaatgtatctaaaggcgatattggttttaacttcaccgataataacgtcatcaaaaaaatagacgtggataagcttacccagacacaactgattaatgggcgtctcgcgattgcgcgtctggttatcaataacagcggtgaatgtgaatatgcgattattcccgcgagcgtcgccgataaaatcgcacaacgagatgcggacagtattgtcgtaaacagtgcgctgagtcaggaagagcaggacgaagatgatccgtatgccgattttaaagttcctgacgatttgatgtggtaagtcacattcccaacgtttatgtagaaaaatttctcagagagtaaatatgctgaccgacacatctacccggcttaataaatatatcagtgaaagcggcatctgttcgcgtcgcgaggcggaccgttttatcgaacagggcaatgtctttatcaacggcaaacgcgccgccattggcgatcaggtggtcgccggggatgttgttaaagtaaatggtcggttgattgagccgcgagaagcggatgatttagtgctgattgcgctgaataaaccggttggcattgtcagtaccactgaagacggcgaacgcgacaatattgtcgattttgtgaaccacagcaaacgtatcttcccgattggtcgtctggataaagactcgcaggggctgatatttctgactaaccacggcgatctggtcaataagattctgcgtgccggtaacgatcacgaaaaagagtatctggtgacggtggataaaccgattaccgacgagtttattcgcggtatgggcgctggcgtgccgattctgggtaccgtcaccaaaaaatgtaaggtgaaaaaagaggcgccgtttgtctttcgcattaccctggtgcagggattaaaccgtcagatccgtcgtatgtgtgaatactttggttatgaagtgacgaaactggagcgtacgcgcattatgaacgtcagcctgagcgggattccgctgggcgagtggcgcgatctgacggacgatgagctgatcgatctgtttaaattgattgagggttcctcttccgaagccaaaccaaaggccaaagcgaagccgaagaccgcgggtattaagcgaccggtcgtggcgatcgaaaaaagcaatgagaaagcgcgcccggcatcaagcggtaagcgctttacctcgccgggacgaaagaagaaaggacgttaacgtctgccgcgcgtcggcgtattcgccgaccaggagaatgacgcttccgtatcgggtttatacgcctgctttttcttcaactggcgggcttttttcgcttcagcctcacgcagcgccatcagcttatcgatgtactccttttttacgctgttggtctcagaattggtcagcggacgcccgtgcgcaatacgggcgcggtccagcaacgttttcagttcgcgctgttcgcgctcggtcatctctttttgggtaatgcgggggagtgccatacgggtgccctcagttagccgatgcatttagtctacggcaatacgcaacgggcggatagcgctcagtcagcaatccgcagctttccagcgaaatcctgtggcgtataacccgttgacgtaaatcctttatccgtgatgatgttatcgatttcttttacgcttgcgatgcacatcacaccgtcctgaccaaatttggtatggtcagcgagaatcactgattttttgctcatcgcaatcatggctttggcaacgtaggcttcttcaaagctcttcaccaacacgccatgctggggagaaatgccgccagcgccaataaaacagatatccgcgtgaatcgcgttaatctgctgacataccgagacgccgagattagcgcgaaaatggtaatcatattcgccgcctaatacatacacgcgggcctgcaggttatgctctttaattttatcggcaatcagtgctgaattggtaatcacggaaaaagcgagaggcggtaattgctcggccagaataaggttagttgtacaggaatcaataaacaatgtatcccgttcactgatcatttcggcggcaagtttgccaatcgctattttctcttcgcgatgcgcctctattcttgcgctaaacgcatcttcctggacaacttgctttttgaccgcgcccccatgaatcttagtgattttgccttctgattccagtaaggagagatcgcgacgaatggtttccgaggtgacgttgagcatttccgataatttaataacggtgacttcaccgaatttgtttaattcatcaagaatatgttttcgtcttttaattggattcattatctttcgccgctgtcaacctttggcgcatggtaactggatgcgtaaggcaacgcaaccactccaacgcatggacgataccctcctcatcattcgtggcagtcacatagtcggcctgccgctttactgcatccggcgcgttgcccattgcgatgctgattccggcggcggcaaacatgctgacatcattctgctgatcgccaatcacgaccaccttgtcagaagatatatttaaataatgaattaattgttctattatgcaccctttatttacatcggttctttgaatatcaatataattttctcccgtgacgaccgcataatatccataaggcaggtgattattcacttctgtacacagtgtatctatctccgaagatacggcaacaagggtaattttatatatatcgcgacgattaaagatattttctgtagtttcagttataagcggcaacccaaataagcgggcttcatatgttgtccagggcgcaatcagtctatcgtcacgatggtgaattgcttcggcgctaaaaaaatggtggtgatagcgggaaagagaaatatgctggtcaatattccacagatctgtggcggacaacggagcagcatgaataatgcgctgccccgccatctccagaagatgtccgcagttaaaaccggcgcaccagctaaacaacctatcaacctgttgttggtgtagcaggcgtaccattgaggagaccggtctggcggaacatgccgccagcagactaccgtcctggcggaacgcaatcagcgcctgacgcgtgcgcgggctgattgttttctgcgaggtgagtaatgttccatccagatcggtgattaacaacatctctcgttccctgatatcaatgaacaataaacggcgtaacggcttctttggcggcgttgcacaccatgttgtcgatagccgtaccgaccaccagaatattgactccggtatctttaaacgctttcgcgttggcgaggttaatcccgccttccgccagcgtcggaacatccaccgcgccgaccaacgcccgcaggcgatctttaatcatctgcgggatatcgcctgccgctacgccttcatagctcatgcctgtcatcagaccaatcatatccacgccgatatcctgcatccgcttcgccacgctggcgacctcttccggcgtgcgtgcaggaataccgaaagtatgcagatcgtcaggatggccaatgtaggcatcgacggtcagaccatattgatgggcgagattaacgatgtcctgcagatcgtcccagtcggatttatgcgtatgtaaaccgtcggctccagcgcgggcaatctccagaatttccgtttcgctgagcggcaccggtaaggtttcggtaaaaccgccggcgataccaacggtgataaaaatatcgtccgggaccacattacgaacaccgtgtacggcctcagccatctggctattggtgatttcgtgacgaatctgctccgccgcgtgcatgttgctcacgcctttgtgtccacgcgccagcgccaacgcagggtggttcggctccagaagcttaacgccagcctcacacacggctttcgccaggcgcgcatcgtcgccagttattcctgtgctgaggatagtttgcccaccgtgaagcgtgatggcttctttcactttctgtaacgctttggcgcgttttttattcatatcgcctttaaacatggtgtacctctggtgttggtgcattaattaacggctgtcgttgttgattcgctctgtacgacaggtttgaaacggttagcaataatggtggtaaggcaggtcatcgccattgtggcaatcattacgatggccatctggagcgcattgctggataagaacggtgaggcgaaagccggaacataggccacgcctttgacgttaaaaaagcccagcatcatgccgcccattccggcccaaaaaatggcggagccaaaaacaattttgttggcgaacatgaagggataggcggattcaacaaaggtgccaaaacccaggttaatgagcaggcccggcgtagcaacggcagcttcgcttttttcacgcggggcgatcacattggcaaggttaatacctgcggccaccatcaccagaccgaccatatcgaccgcgccgaggaagctgacgccggatttttccatctccagcagtaccaacggcaggatcaccgcgtgatagacgccgccgagaatggcaggccagataaccagaccagccagcagcccggcaagaattgggctgaatgccagcgtgctttcgatagccagtttgatgtaattacccgcagatagcgccagcggactcagcagatagtgcatgattaacccagcggcaaggcccgatatcccaccggcgacgatgttgacggtagtcattgggaagcgccagttcaggcacagctcgaacagccaacggacgaaaatccccgccattacaccgccgataatgccgccgatcagtccgccctctacggaaagcacgccagcgacgaccccagccacaattgaaacttcatccagttcggaaatctgttttgccgccagtaccgcgactaacactggcagaccttttagtaatatttcaaagatatcgttaagtttttccagtcctggtatgtggctcagggcgagtacaatcgccatggcgataaagcctggtagcgcagggatcatgatgctacgaatgttaaaacgtttgagcaggctttttccggaaccgctctgcgagggcgaagcgctacccaactgtggtttgtacttgataccccaatgtttacatagtgacgccacgaaggagacggcgcgggtacggctggtggtgccggttgttccggaggtcgcgaccacattcgccccctttgccgccaccagcgccatggaggttcccccggtgccgacaatcggtgttttcatctcaacggcggcggcaaaaatggcttggttcgcctttaccggatcggcgctcattaccacgatcccatcgatctcaccgcggcggatcatctcagcgatttggcgatcgctttctactaccgaggtgtttacctccgaaagcttaccctgaaatatgcgctgtggtttttgttggttttctgtggttaatgcataaaccgatgccggggtgtccggtttggcgacgtccatcgaggcctctgccgcgataaattgtacggcggccacattcacgcccgcagcctcacactgctgataaatctcctggagtaacttctctggctcggcgccacccaggttgtagaggttgcctccactgcttccaataatcgcaattttttcatagcggcctcaaatagggtaagggggttatctgtgttgtagtgcaatcataattccaactaaaacaaaataaagcaacaatgaaaaagtgcttttataccaaacgatctcaatttttaaaggtaagttattaaaatataatgataaatttatgtttttgttttgtgttgttttgcgtggttttgtgacgaggttcaaaatgaggagggcataaataggggaaagctgcccatattgatgggacgagcagggtgtacagattcctgccttctgtaattggctttctggagcagtattccgccggcagtgcctgacgtgggaaccgccggataaggcgcttgcgtcgccatccggcagcgtattgcctgatagcgctcacccgctgtcgtgtcagggcgattattcaaataagttctgatgtagcttttgcaccactttctcggcatcgtctcccggcacgaggaagcacagattgtggctggaggcgccgtaacaaatcatgcgaatgttgaacggttccaggacgccaaacacttctttaccaacaccgcaggcttttgacaggttgttgccaatcagcgcgaccagcgccagtccttcttcaacttcgacccgacacagcgcggaaagctccatcaataaggattgggtcagtaacgtatcgcccgtggaggtggagccggtagtatccagcgtcagcgcgacgctcacctccgaagtggtaatcagatctaccgaaatattatgccgcgccagaatgccgaacacctctgccaggaaacctcgtgagtgcagcatattcaggctgtgcagcgtcaatagcgtttgattgcggcgcagcgccagcgcgcggaacagcggcgggttttgggttttattgcacaccagcgtaccgcccgcttgcggatctttactggagccaacgaagaccgggatatcgctgcgcacggccgggagtaaggtggctggatgcagtacttttgcgccgaaggttgccatctccgccgcttcttcaaagtcgatttcatcaattcgctgcgcgacgggcactacgcgcgggtcggtggtgtaaataccgggcacatctgtccagatatcaacccgcgcggcgtggagcgcttcagccagcaacgctgccgtatagtcgctgccgccgcggcctaatgtcgtggtgcggcctttgctttcactgccgataaagccctgagtaatgaccaacgtttcgctcaggcgcgggagcaactgctgcgcggccagttccgcaagcgctgcgacgtccggttccgcacgaccaaagcgatcgctggtacgcatcactttgcgcacgtcgaaccagtgggcctgtacgtcgcgttcacgcaggatctcaacaaatagcagggtagacattagctcgccgtggctgaccagttcatcggtcagggctgccgatgtcgccagcgatgccgcctccgccagaatagtgatgttttccagcaggcgttcaatctcttcgcgaatgacattcggatgacgcagacgatcaaggatatcgaactggattttacggatggcgtcgagcgtagcgaaacgttcgccgggctccatcccttcggccagcgccaccagcagattagtgatgccggcagacgcggaaagcacgactaaacgaacattggcgtcggaaagtacgatatccgcgctacggttcatggcgtcaaaatcagcgacgctggtaccgccaaatttggaaacaacgatctctgtcatatcaacctcgtgtcaggaaatgaaaaacgcgaccatggcacaaaggcagaacagaaaccggtgcaggcgcaaatgcaagtaacgtatttataaataaaagttgtggactggactgtcaacgttgggattatgcggattttttatgctgagtttaggctcagtaacagcgcttataaccccgatacccgtttgtaggaatgttggcttatctatgcgcccggcgactcacccacttgccgcctttctgcacctcgaattatttagggtatatactttttatcctcattcgacagtgcctggggcaacggcactaaaacaatcacacttttctgtgactggcgttacaatcgatcccagtcacaattctcaaatcagaagagtattgctaatgaaaaacatcaatccaacgcagacttctgcctggcaggcgctccagaaacactacgacgaaatgaaagacgttacgatcgctgagcttttcgcgaacgatagcgaccgtttcgctaaattttccgcgacgtttgacgatctgatgctggtggacttctccaaaaaccgcatcaccgaagagacgctggcaaaattacaggatctggcgaaagagaccgatctggccggcgcgattaaatccatgttctccggcgagaagatcaaccgcaccgaagaccgcgccgtgctgcacgtggcgctgcgtaaccgtagcaatacgccgatcattgtggacggcaaagatgtgatgccggaagtgaacgccgtgcttgagaaaatgaaaactttctcgcaagcgattatctccggtcagtggaaaggctacaccggtaaggccatcaccgacgtggtgaacatcggtatcggcggttccgacctcggcccgttcatggtgaccgaagcgctgcgtccgtataaaaatcatctgactatgcacttcgtctctaacgttgatggtacccacatcgctgaagtgctgaaaaaagtgaacccggaaacgactctgttcctggtggcgtcgaaaaccttcaccacgcaggaaaccatgaccaacgcccacagcgcgcgcgactggttcctgaaaagtgcaggcgatgaaaaacacgtggcgaaacactttgctgcgctctccaccaacgccaaagcggtcggcgaatttggtatcgacacggccaatatgttcgagttctgggactgggtcggcggtcgttactcgctgtggtctgccatcggactgtccattattctgtccgtcggtttcgacaactttgtcgagctgctttccggcgcgcacgcgatggacaagcatttctccaccactccggcggagaaaaacctacccattctgctggcgttgattggcatctggtacaacaatttcttcggcgcggaaaccgaagccattctgccgtacgaccagtatatgcaccgtttcgccgcctacttccagcagggcaacatggaatccaacggtaaatacgttgaccgtaacggcaacgccgtggattaccagacaggcccaattatctggggcgaaccaggcaccaacggtcagcacgcgttttatcaattgattcaccagggtactaaaatggtgccgtgtgactttatcgccccggctatcacccataacccgctatccgatcatcatcagaagctgctgtctaacttcttcgcgcagaccgaagcgctggcgtttggtaaatcccgcgaggtggttgagcaggaatatcgcgatcagggtaaagatccggcgcagcttgaacacgttgtgccattcaaagtgtttgaaggcaaccgcccgaccaactctatactgctgcgcgaaattacgccgttcagcctgggcgcgctgattgcgttgtatgagcataaaatctttacgcagggcgtcatcctgaacatctttactttcgaccagtggggcgttgagttgggtaaacagttggctaaccgtattctgccggagctgggcgatgataaagctatttcgtcccatgatagctctactaacggtctgattaaccgttataaagcctggcgcgcctgatggcgctgcgcttatccggtctacgtaatgcatagcgtctgtaggccggataaggcatttcgccgccatccggcaaaaagagaataagataataaaaaggccgatattcacatcggctttttttataagataattccgcttgtccgtctttatccccacaattttatattgagcttaatcctaaaataagcaataaccagaaaatcactctgcgttattttcagattatacggatgctgatgtcttttagtttaattttaacttatttattttatttgttttttaattaaataatataggcgttacttctttaaagtttaattatcctaaaacctcgctgttatttctcccggacataatccgcctgctttggttgtgtatactcggtagcgcccgaaattcttttgggtaaatctccattcattcaatgaagggaaattatgatgaaaaaagtactgtatggcatttttgccataaccgcgcttgcggcgacatctgtctcggcagcccccgttcaggtgggtgaagcggcagggtcggcagcgacgtcggtatcggcgggaagctcctccgctaccagcgttagcaccgtaagttcggcggtgggcgtcgcgttagcggtaaccggcggcggcgatggttccaataccggaaccacgaccaccacgaccaccagtacccagtagtatcggtacgtttaaccataaccacactccggtgtggttattttgcccctctggagaagcgtcgtgaagcgactcgcacttatcctgatttgcctgctattacaggcgtgttcggccaccaccaaaggcctgggcgattcactgtgggacagtttgttcggtacgccaggcgtacagctaacggatgacgatattcaaaacatgccttatgccagccagtacatgcagcttaacggcggtcctcaactgtttgtggtgctcgctttctcggaaaacgggcagcagaaatgggtgacgcaggatggcgcgacgatcgtgacgcagcatggccgtctggtcaaaacgctgctcggcggcgacaacctgatcgatgtgaataatctggcgaccgacccgctggcgaaaccaggacagattatcgatggcgcgacctggactcgcaccctgggctggaccgaacatcgccaggtgcgttacgccaccgcccgttccgtttttacatggcgagggaccgatagagtgaacgtcggcagtgaggaaaccgccgtgcgggtgttagatgaagaagtgacgaccgatcaaacgcgctggcgtaatcgctactgggttgatagcgaaggccaaattcgccagacggaacagtatctgggcgcgaattactttccggtgaaaaccacgctgattaaggcggcaaaatcatgatgaaaaggacgataagcgcgctggcgctggcctttgtcgcgtcatccgcctttgccagcggcactgttaccgtttttacccagggtaatagcgagcctaaaacgctgacagacgctgagcgtctgctcgatttagtcggacagccgcgcctggcaacgagctggtggcctgcggcggtgataggcgaagaacaggcgaccgtgacggcgcgtcagcagcagcaggaacttctcgggcgactggcggcgctcagcgctgaggaagatggcgatgcggcggcgataaacacactacgccgacagattcaggcggtgaaggtgacgggcagacaattcgtgaatcttgatcctgacgtggtgcgggtgagcgaacgaggtaacccgccgctgcaaggtcactacacgctctgggtcgggccgcaacccacgcaggtgacgctctttggcttgattagccagccgggcagccagccgttcgtccctgggcgggacgtcgccagttatcttgaggggcagcgcttactcagcggcgcggatcgtagctatgcctgggtggtttaccctgatggacgcagccaaaaagcgccggtggcttactggaataaacgtcatatcgagccgatgcccggcagcatcatttttgtcggttttgccgattccctttggcgcggcacgccggaggcgataaatgccgacattcttcataccctgacgcagcggataccggaataatgaaaaaaacacatctgctcagcgtgctggcgctgggtattagcgcggcctgccatgccgaaacatatccagcccctgttgggccttcacaatctgactttggcggcgtgggcctgctgcaaacgccgacagcgcgtatggcgcgtgaaggggagatgagcctgaactatcgcgataacgatcagtaccgctactactcggcttcggttcagcttttcccgtggctggaaaccacgttgcgctataccgatgtccgtacgaaaaagtacagcagcgtggaatcattctccggcgaccagacttacaaagataaagcgtttgatgtgaaactgcggttgtgggaagagagttactggatgccgcaggtggcggttggcgcgcgcgatatcggcgggacggggctgtttgatgcggaatatattgtagcgagtaaggcttgggggccatttgatttttcattaggtctcggctggggctatcttggcaccagcggcaatgtgtctaatcctttctgttcgtatagtgataaattctgttcgcgtgataacagctataaagaggccggttccgtcgacggtagcgatatgtttcacggcccggcttcgctgtttggcggcgtggaataccagaccccgtggcaaccgctacgcctgaagctggagtatgaaggcaataactatcagcaggattttgcggggaaactggaacagaagagcaagtttaacgtcggcgccatttactgcgtcaccgattgggccgacgttaacctcagctacgagcgcggcaacacctttatgtttggcgttacgctgcgcaccaatttcaacgatttacgtcccgcgtatcatgacaattcacgcccgcaataccgaccacagccgcaggatgccatcctgcaacattcggtagtggctaatcaattaacgttattgaaatataatgccggtctggcggacccgaaaatccaggtcaaaggcgatacgctatacgttaccggtgaacaggtgaagtaccgcgactcccgtgaggggatcgtgcgcgctaaccggatcgtcatgaacgatctgccggaggggatccgcacgatccgcgtgacggaaaaccgccttaatctgccgcaggtcaccactgaaaccgatgtcgccagcctgaaacgccatctggaaggcgaaccgctgggacatgaaactccgctggcgcaaaaacgcgtggagccgatcgtgccagagagtactgaacagggttggtatatcgacaagtcgcgcattgattttcatcttgatcccgtgctgaatcagtcggtaggcggcccggaaaacttctatatgtatcagttgggcgtaatgggaactgcggatctgtgggtcacggatcatctgctcaccacgggcagcgtgtttgccaatatcgccaacaactacgacaaatttaactacaccaatccaccgaaggactcgcatctgccgcgggtgcgtacgcatgtccgtgagtatgtgcagaatgatgtttatgtgaataacctacaggccaactacttccagtattttggcaatggtttctatgggcaggtctatggcggttatctggagaccatgtttggcggtgccggggcggaagtcctgtatcgcccggtagacagcaattgggcgtttggtctggatgccaactacgtgaaacagcgtgactggcgtagcgcgcaggatatgatgaagtttaccgattacagcgtgaagaccggacatttgaccgcatactggacgccgtcgttcgcccaggatgtgctggtgaaagccagcgttggtcagtatctggcgggcgataaaggcggtacgctggagatcgccaaacgcttcgatagcggcgtcgttgtcggcggttacgcgacgattaccgatgcgtcgccggatgaatatggggaaggggattttaccaaaggcgtatatgtttccgtaccgctggatctcttctcgtccggcccaacccgaagtcgtgcggcaattggctggacgccgctgacgcgtgacggtggtcaacagcttggccgtaagtttggcctgtatgatatgaccagtgacaggagcgtaaatttccgttaatactcaggccggataaggcgttcacggcgctatccggcaaattaccttattgaacaaaatataaacacaaataaaaaatatagatgcccgtcacatttgtgcgttatacagaaacctcgccgcagagaaagagggggctgttatgatgccattatcgcgctcacgtcttgagtttatcgccacgattttacaaaacgtactaaatttggggctgcttaccctcggtctgatcctggtcgtttttctcggtaaagagacggtgcatctggcggacgcattattcgcgcctgagcaagccagcaaatatgaactggtggaagggctggtgatctactttctttatttcgaatttattgcgctgattgtgaagtactttaagtctggccttcactttccgctgcgctatttcgtgtacattgggatcacggcgattgtgcgtctgatcattgtcgatcataaaacgccaatggatgtattactctattcggcggcgatcctcctgttggttatcacgttgtggttatgtaattcgaaccgactacggcgagaataggcgtcgccacaccgtaacggacgtatggcgtggcaataaattagccgctgtctataacgcataaaaaaagcgctccgaagagcgccaaaatacgaccataagtggggataacataacttgagggcagtggcattgcccgttgccgggcaggtacttcgataaaacttaacctttcacaccccctgccgtcaggccgttgaccagccaacgttgcgccaacaggaacaccagggtgataggaatagctgaaaggacggcggcggcggcaaagtcgccccacaaatagttttgcgggttgagatattgctgcatacccacggccagcgtatagctgtccacatcgcgcagtaacaacgaggcgaccggaacttcggtaatcgccgcgatgaacgacagaataaacaccaccgccagaatcggtacggaaagcggcagcagcaccagacgaaatgcctgccacggggttgcgccatccagcgcggcggcctcttccagcgagctgtcgatagtttcgaagtagcctttaattgtccagacgtgcagcgcgatgccgccaagataggcgaagatcacgccgccatgcgtattcagaccgataaatggaatgtattgtcccaggcggtcaaataacgcatacagcgccaccagagacaaaaccgccggaaacatctggaaaatcagcatccctttgagcagtgttgctttacctggaaaacgcattcgtgcgaaagcgtaggcgcaggtggtggagagcgccacgatgccgatggcggtaataccggcgattttcaccgagttccacagccacagcaggaccgggaagggaggcggcgttacccgaccatccgcatgttccacgctgaaacccagcgccagccgccagtgttcccaggagattttatccgggatcaggcttccggtggcgaagttcccttcacgtagcgagatagcgatgaccatcagcagcgggaacataatcgccgcgatgaaaatcagcagccccaggtgcgtgatgaagagacgcagtttctgagatttgggttggaccatagccattgttattatctcccttaatcaaacttcatacgcgtggctttcaggttcactattgccagcgcgcctaccagcaggaagatcagcgtggcaatggccgccgccagaccgaagtcctgaccgccgccgccttcaaaggcgatacggtaggtgtagctgacgagcagatcggtataaccggcaggcgtggtggtgccgagacggtctggcccgccgttggtcaataactgaatcaggacaaagttattaaagttaaaggcgaagctggcgatcatcagcggcgttagcggcttaatcagcagcggtaaggtgattttaaagaaattctgaaatggaccagcgccgtccattgcggaggcttcgtacaggtcatccggaatcgctttcagcagtcccatgcacaggatcatcatgtagggatagcccagccaggtattcacgataatcaccattgcccgcgcggtgttggggtcgctgaaccaggcaggtttaatgccaaacagcgcgctcagcatcatattgatttcgccaaagctttggttgaataaccctttgaaaatcaaaattgaaataaacgacggtacggcgtagggcagaatcagcaggacgcggtagatagctttacctttcagcgcttcccactgtacgaggcaggccaataccatcccaaccgccacggttaacaccacagtgaggaccgaaaagaccacggtccagacgaagatagcgaaaaaaggcttctggatcccttcgtcggtaaagacgcgcgtaaagtttttcgcgccgatagtaacggtataaccaggactgagtttttcatcaccccagcttccgtcggcgttgatcgactgataataaccgctatcgttgtttggccggtattttacgccgctctggttattggtaagcaggccgtcatcagccagtgtgtacagcggacgggtaccggaaaactgacgcagcgagctcataaccactttactttcatccggcaggacggcggttatctggttcagcgccagacggttctgggtgattatccgcagattggcgcgttcgccgcccggcagggcatcggtctctttcagctgtaatttttgttcgccgccgaaggaaaatgcgccagacaggtaatgtttgcccgtttctccgtcggtgagggccagttgccactcgtcgccggccgggtaaagaccgaagttataggtttttcccgcctgataagaacggtccatcagcacttgctgggcgcgttcaaaggtgagctggttggtgctgctgtagttagtaaaggcgatggcgatggtgcacaccagcgggaatagcacaaacagccccatgccggcgaggccagggtaaacgtagcgccaggcataggttttacgatttgcgaaaatatacaggccagcagagcttaaaatcagcgtcatgatggcgaacagatactccccttgtacgtacattaaaactacaaggtaacccaccagcaggcccagcagaccaattactgaccatttaagctggtcgctttgccaccagtgtttctttttaatgacatccatgggggttttcctctacagcgttgaaacttcctggccggagatgtgcctgatggcgctgcgcttatcaggcctacggtgtgttgtaggccggataaggcatttatgtcgccatccggcacaggctcgcggcattacttggtgatacggctttgtgcatctttcagcgcggcatccacggtttgacggccgctggcggcgttaatcacagccgtacgtaccgcataccagaaggcggacatctgcggaatattcggcatgatctcgcctttctgggcgttatccatggtggcggcgatacgggggtctttcgctaactgctcctggaaagatttcagcgccacggcgcccagcggtttgtctttgttcaccgcctccagaccctgatcggtcagcaggtagttttcgaggaactctttcgccagctctttattcgggctggcagcgttaatccccgcgctcagcacgccgacgaacggtttcgagggtttacctttgaaggtcggcagcagggtgacaccgtagttgactttgctcttgtcgatgttcgaccatgcccacggaccgttgatggtcattgccgtttcgcctttattgaaggctgcttcggcgatggagtaatcggtatcggcgctcatatttttgttcttgatcatatcgatcaggaaagtcagacctgctttcgcgccggcgttgtcgacgccaacgtctttcacgtcatacttgccgttttcaaatttgaacgcgtaaccgccgtcagcggcgatcaaaggccaggtgaaatacggctcttgcaggttgaacattatcgccgacttccctttcgcttttagctctttatccagcgccgggatctcttcccaggttttcggcgggttcgggacgaggtctttgttataaatcagggagagggcttcaacggcgatggggtaggcgatcagcttgccgttataacgtaccgcatcccaggtaaacggatagagtttgtcctgaaacgctttatccggagtaacctccgccagcagaccagactgcgcgtagccgccaaaacggtcgtgcgcccagaagataatgtcaggaccgtcgccggtggcagccacctgcgggaatttctcttccagcttatccgggtgctcaacggtcactttaatgccggtgtcttgctcaaattttttaccgacctcggccagaccgttatagcccttgtcgccgttgatccagataaccagtttaccttcttcaattttggcgagagccggggcggaaatcatcatcgtcgtaagtgcggataatgcgaggatgcctacgccagttttaatcttcatatctcccatcctttttggtgatgtacacagaggtggtttaacggtctctagtttctttatacgacaacctctttccatcctccctacccctacgccccaccccggctttatgtgatctgtgttgcataaatgtgagtaatgcgtgctggcgcacacaaaaacacgccgatttttgcgggcggcatcacgaaattccttttctgtccgcgcccgtggtctcaggcgttgtgtcctcatcctcccgcctcctcccccataaaaaagccggggggtggaggatttaccccagtcagggatcgcgcatagtcaggccatcatgaatgttgctgtcaatgacaggttgtaacgaagggagaagggcatggcgagcgtacagctacgaaatgtaacgaaagcctggggtgacgtggtggtatcgaaagatattaacctcgatatccatgacggggagttcgtggtgtttgtcggaccgtcaggctgtggtaaatcgaccttgctgcgtatgatcgccgggcttgaaactatcaccagtggcgacctgtttatcggggaaacccgtatgaatgatattccgcctgccgagcgcggcgtgggcatggtattccagtcttatgcgctctatccccatctctccgttgcagaaaacatgtctttcggcctcaagctggcgggcgccaaaaaagaggtaatgaatcaacgcgtcaatcaggtggcggaagtactgcaactggcgcatctgctggaacgtaagccaaaagcgctttccggcggtcagcgtcagcgcgtagcgattggccgcacgctggtggcggagccgcgtgtgtttttgctggatgaaccgctctctaacctggatgccgcgctacgcgtgcagatgcgcattgaaatttctcgcctgcataaacgtctgggccgcacgatgatttacgtcacccacgatcaggtcgaggcgatgacgctggccgacaaaatcgtggtgctggacgctggtcgcgtcgcgcaggtcggtaagccgctggagctgtaccactatccggcggaccgctttgtcgcgggctttatcggctcgccgaagatgaacttcctgccggtgaaagtgaccgccaccgcaattgaacaagtccaggtcgaactgccgaatcgccagcaaatctggctgccggtcgaaagtcgcggcgtgcaggtcggcgccaatatgtctttaggcattcggccggaacacctgctgccgagcgatatcgccgatgtcaccctggaaggtgaagtccaggtggtcgagcagttagggcacgaaacacaaattcatatccagatccccgccatccgtcaaaacctggtttatcgccagaatgacgtggtgctggtagaagagggcgccacattcgctatcggcctgccgccagagcgctgtcatctgttccgcgaggatggcagcgcatgtcgtcgtctgcatcaagagccgggtgtttaaggcctccataaaaaaacgaaacgcaaaaccattcgcagttttagaaggtggcagcgtttaaagaaaagcaatgatctcaggagtatagaatgatgattactctgcgcaaactccctctggcggttgctgtcgcagcgggcgtaatgtccgctcaggcaatggctgtcgatttccacggttacgcccgttccggtattggctggacgggaagcggcggcgaacaacaatgtttccaggtgaccggtgcacaaagtaaataccgtctcggtaacgaatgtgaaacctatgcggaactgaaactgggccaggaagtgtggaaagagggcgataagagcttctatttcgacaccaacgtcgcctattcggttaaccagcagaacgactgggaatcgaccgatcccgccttccgcgaagcgaacgtgcagggtaaaaacctgattgaatggctgccgggctctaccatctgggccggtaagcgcttctatcagcgtcatgacgtacacatgatcgacttctactactgggatatttcaggtcctggcgcaggtatcgaaaatatcgatctgggcttcggtaagctttcgctggcggcgacccggtctactgaagcgggcggctcttacaccttcagcagccagaatatttatgatgaagtaaaagataccgctaacgacgtctttgacgtacgtctggctggtctgcaaacgaacccggacggcgtactggagttgggcgttgactacggtcgcgccaatacgaccgatggttataagctggctgatggggcatcgaaagacggctggatgttcaccgccgaacacacgcaaagcatgttgaaaggctataacaagtttgtcgtgcaatatgccaccgatgccatgaccacgcagggtaaaggccaggcgcgcggttccgacggttcttcatctttcactgaagaattgcctgatggaaccaaaattaattatgccaataaggtcatcaataataatggcgatatgtggcgtattttggatcatggcgccatctcgcttggtgataaatgggatttgatgtacgtcggtatgtaccagaatatcgattgggataataacctgggtactgagtggtggaccgtgggcgtacgtccaatgtacaagtggacgccaatcatgagtaccctgctggaagtcggctacgacaacgtgaaatctcagcagaccggcgatcgtaacaatcaatataaaatcaccctggcgcaacagtggcaggcgggcgacagcatctggtcgcgtccggctatccgtattttcgccacctacgcgaaatgggatgagaaatggggctatatcaaagacggcgataacatttcccgttatgccgcagcgactaactccggcatttccaccaacagccgtggcgatagcgatgagtggaccttcggcgcccagatggaaatctggtggtaatacgatggtcatctgacgtaacgaggggcgcaagcccctctgaaacatcaggtctgatgatgcttgtaagccgaataaggcgccagccgccattcggcgatatgtttgggttggcgcgctattgcctggctaccgctgaacccgccttattgaggtgagaataatgaaaatgaagaaaagtctcgtcgccctctgtttaaccgcagggctgttcgccagcgtgccgggtatcagcctggcggaagtgaactatgtaccgcaaaataccagtgccgcgcccgctattcctgctgctgcgctacagcaattaacctggacgcctgtagatcagtcaaaaacgcagtctacccaactggcgacgggcggccagcgccttgacgtcgccggcattaccggcccggtcgccgcttatagcgttccggcgaatatcggcgagctgacattaactctgaccagcgaggtcaataagcaagccagcgtttttgcgccaaacgtgttgattcttgaccaaaatatgacgccttcggcgttcttccccagcagttactttacttatcagcagccgggcgtcatgagcgcagatcggctggaaggcgtgatgcgcctgacgcctgcgttggggcagcagaaactctatgttctggtgtttacgaccgaaaaagatcttcagcaaactactacgctgctcgatccggcaaaagcctatgccaaaggcgtcggtaactctatcccggatattcccgatccagttgctcgccataccactgatggcgtggtgaaactgaaggtgaaaaccaacagtagctccagcgtattggtcgggccgttgtttggctcgtccggtaccgggccggtaacggtaggcaataccgccgcgccggtcgctgcgccagcgccagtcgcgccgaagaaaagcgaaccgatgttgaacgatacggaaagctattttaataaagcgattaaggatgccgtagcgaaaggcgacgtcgataaagcgctgaaactgcttgatgaggccgaacgtctgggatcgacatctgcccgttccacctttatcagcagtgtaaaaggcaaggggtaattgtttccccacagtgctgattttgcagcaactggtgcgtctcctggcgcacctttttttgtcatttcatgcgaattgttatttttttgttgcgcaacagatcacttaattgtgattgcgccccccgtaatgtcttttctgagatacaatgactttaggttatgaatcggagagtaaggcatgtcacaccctgcgttaacgcaactgcgtgcgctgcgctattttgatgcgattcctgcgcttgaaccccatttgctggactggctgttgctggaagattctgtgactaaacgttttgagcagcagggaaagcgggtaagcgtgacgctgattcgggaagcgtttgtcggccaaagtgaggtcgaggaagcatcaggtttactgccatccgagtcccgctactggttacgtgagatactgctttgcgctgacggcgagccctggcttgccggacgtaccgtggtaccggaatccacgctgtgcggacctgaacaggtcttacaacatctgggtaaaaccccgcttggacgttatctatttacatcatcgacactgacccgcgattttattgaaattggacgcgatgcaacgctgtgggggcgccgctctcgactgcggttgagcggaaaaccgctgttgcttaccgagctttttttacctgcatcgccgctgtactgagaggaagataaagatggagtggagtctgacgcagagtaagctgctggcgtttcaccgtttgatgcgtacagataagcctattggcgcgttgctgctgctctggccgacgctttgggcgctatgggtggcgacgccgggtatgcctcagctgtggattttggcagtttttgtcgctggcgtgtggttaatgcgcgcggcgggctgcgtggtgaatgattatgccgatcgtaaatttgacggacatgtaaaacgtacggtcaaccgacctttacccagcggcgccgtgacagagaaagaagcgcgcaacctgtttgtggtgctggtgctgctggcgtttctgttggtgctgacgctgaacgccatgacgattctgctttccgtggcggcgctggcgttggcctgggtttatccctttatgaaacgctacacccacctgccgcaggtcgtgctgggggccgctttcggctggtcaatccccatggcgttcgccgcggtgagcgaatccctgccgttgagctgctggctgatgttcctcgccaatattctctgggcggtggcttacgatacgcaatatgcgatggtcgacagagatgatgatatcaagataggcattaaatcgactgcgatcttgtttggtcgttatgacacattgattatcgggattctgcagcttggcgtcatggcgttaatggcgctgatcggctggttgaatggtctgggatggggatattactgggctgtgctggtggcgggcgcgctgtttgtctaccagcaaaaactgattgcgaaccgtgaacgtgaagcctgctttaaagcctttatgaacaataactacgttggcctggtgctatttttagggctggcgatgagttactggcacttctgatgtcatgccgggcgaacccggcctacaaagccaaaattttcaatacgtcatatcagttgcccgatgagcttgcactatcgggcatttcaggcactggcttactcgccctgcgtcgcgctttcaatcgtcagacggacatcagaggtaattagatcggcaagcatctgatatatcttcatcgtttctgccggttcggcatcgcccgtatcactgatataaccctcatcccgtagcgtcaacacgagtgaactgaacaccgctttgtcgaaaaactccggcgcgttaataccgtgcaggacagacagacgttgcgccacggtacggctttctttctccagcgtactgcggttgatggacggattggcgctcaatagccagaacgtaatggcataacgctgtagcgtttcacgcgcgcctgccgccagcagttgcagcgtacgggaatgcgtcgggttgatatgcagttcatcatcctgcagggtaattagcccctgacgctgcatttcactggccagcgcgtcgatgaccgaggctaactcctcgcgctcccagcgcaggaacagctccgcttttaacatcggatagagcgcttcaacatgctgctgcaacgcatcacgcgaaatgcgacgatgctgggtgataatcgccgccatcagcgaaggcataatcaacatatgcgcgatattgttacgataataggtcatcaacaccgcctgctcgcgcggcaggatgatgatatcgccaatggtgtctttctcgacctcaaacttattcatctgcagcgcgtgagcgatgagctcgccagcgctggcggcaggaaccgttgagtctgtggaataagggacattgcgcatcagatcgagatagcagtcaagctgctcggtgagctgctcgcgggtgagcgagcgctgacgcgacgctaacagcgcggtacaacacaggttcatcgcgtttgccgcgccagcgttgttaatacgcaccatcagatcggcggcaatactatttaccgtcggcgtcagccaggctgggcgtatggcctctatagggtcgatagattcgcgccactctggcacatgctggttcaggtacgtcatgagcggcatcggttcgccaaagttaacgtagccctgacccagattgcgcagcttgctcaagcctttcagcatctgcggcagactctctttctcttttgtcgcgccgcgcagctctttcgcataggtgcccacttccatgacgtgctcatagccaatgtagatcggtacgagggtaattgggcgggtaccgccgcgtagcatcgcctggatagtcatcgacagggtgccggttttcggatctaacaaacgtccggtacgcgaacgtcctccttcgacaaaatactcaaccgagtaaccgcggctgaacagctcgcccaggtattcgcgaaagacggtggaatagagtttattccccttaaaggtgcgacgaataaagaacgcgcccagacgacggaaaattgggccagcgggccagaaattaaggttaataccggcggcaatgtgcggcggaaccagcccctgatggtacagcacataagaaaggagcaagtagtccatatggctgcggtgacagggtacatagacgatttcatgcccgtcgtgcgccagttggcgtacgcgctcggcgttatgcacgttaatcccctggtaaagtcggttccaggtaaaccccaaaatcctgtcggtcaaacgaatcatctcgtaagagaagttcgccgcgatctcttccatcagcgcaatggcgttttgctgcgctttttcatgagagattttcttactgcgcgcttcgtcttctaccgcgcgggcgatcgctttcgaggccagcagtttgttaaacagatcctgacgggcgggcaggcgtgggccaaccgccgccaggcgctggcgagcaaagtgcatacgcgccacgcgagccagcttctgcgcgatgattttatcggtgccgtgttcatcagccatgcgacgcaatgagacggacggcgagaatcggacaaagctatcgcggcccagccaggagatggcaaagaatttctgtacgccgttcagcatacgtaaaggcgggttctcttctcctttttcacgacccggcgcgcggccaaacatcacggaaacgggcaccatctgcacgtccaaagctggattactccgatgcagatcgagataatcgtgaaaaagtttcaccgactcttcttttggcgtgtaataggtaaagacacgcggtccgccgtgaataaatacatagcgtggcaacagcgcgccgtcgatctccagcggctccagcggatccgggagatcgtgcgccagacattgcgcccgcagcgtcagtaagtccgcttttgagttgtatggcaagacatacataatggggcgagaagtatcgagccccaattcctgggcgggttccgccggaatagacttgctttttaccagtatgcttaatggtaaattcagtaatttgtagtaaattcgtggccagccggacataaacgatgtaaagcctctggttaataatgcaaatgcggtgcaaggatatcagaaagtttagcgaatttctgttgtatcccgtcatacttcgcgctgcgttacggcagtccgaatcgtgcagggcaaccgtataatgtcattgacgttaataatgtaaaaaggttcttttgatggccaataataccactggattcaccagaattatcaaagcggcaggatattcctggaaaggatttcgcgccgcatggactcacgaagcggcgtttcgccaggaaagcctcgcggtattgctgggcgtcatcatcgcctgctggctggatgtggatgcgattacccgtgtgttattgataggttccgttttacttatcatgattgttgaaatcctcaacagcgctattgaagcggtcgttgaccgcatcggttctgaataccatgagctttccggccgtgcgaaagatatgggatcggctgcggtgctactgtctattttcgttgccctgatgacctggggcatcctgttatggtcacattttcgataaaggttccaaattttataaatctcttgttttttgcgccgtttgtggttccaaaatcacctttaactgtatatactcacagcatgactgtatatacacccagggggcggaatgaaagcgttaacggccaggcaacaagaggtgtttgatctcatccgggatcacatcagccagacaggtatgccaccgacgcgtgcggaaatcgcgcagcgtttggggttccgttccccaaacgctgcggaagaacaccttaaggcgctggcgcgcaaaggggtgcttgaaatcgtttccggcgcatcgcgaggtatccgtctgttacaggaagaagaggacggattaccgcttgtcgggcgtgtcgcggcgggtgaaccgcttctggcgcagcagcatattgaaggccattaccaggtcgatccttcactgttcaaacccagcgccgatttcctgctgcgcgtgagcggtatgtcgatgaaagacatcggtattatggatggggatttgctggcggtacataaaacgcaggacgtccgtaatggccaggtggttgtcgctcgcattgatgatgaagtgacagtaaaacggctgaaaaagcagggcaataaagtggaactgctgccggaaaacagcgagtttacaccgatagtggtggatctgcgcgaacaaagctttacgattgaagggctggcggtaggcgtcattcgcaacggggaatggttgtaatctctttttaatctccttgtaagccgccatccggcaatcgtgtagcctgatggcgctgcgcttatcaggcctacgggaatgcagttcctgagatgattaatttgtaggccggataaggcgttacgtcgccatccggcaatgcgctcgtttcgtttaactccttgtcaggcttttctccatgccgctttttacctcctctgataaagctctctggcgtcttgcgttgccgatgattttttctaacatcaccgtccccttactggggctggtcgatacggcggtgattggtcatctggacagccctgttttcctgggcggcgtggcggtgggcgcgactgccaccagctttcttttcatgctgctgctatttctacgtatgagcaccaccggcctaacggcgcaggcatttggcgccaaaaatccgcaggcgttagcccgggcgctcattcaaccgttattgctggcgctgggcgcaggcgtgatgattgtgctatttcgcacgccgcttatcgagctggctttacatattgtcggcgggaacgacgctgtcctggtgcaggcgagacgcttccttgaaattcgttggctaagcgctcccgcgtcactggcgaatctggtgctgctcggttggctgttaggcgttcagtatgcgcgggcgccggttatcttgttggtcgtgggcaatatcctcaaaatcgcgctcgacctgtggctggtgatggggcttcatatgaacgtgcagggtgccgccctggcgacggtcatcgcagaatatgtcacgttactgatcggcctcatgatggtacgtaaagttctccatctccgcggtgtgtcgctggatatgctaaaacaggcctggcgcggcaacgtgcgccgccttttggcgctcaatcgcgatatcatgctgcgctcattgctccttcagctttgttttggcgcaatcacggtgtcaggcgcgcggctgggcagcgatattatcgcggtaaatgcagtcctgatgaccttactcacctttacggcctatgcgctggacggttttgcttatgcggtggaggcgcactccggtcaggcttacggcgcgcgtgacggtagcaagctactggacgtctggcgagcggcgtgtcgtcagtcaggaattgtggccttgttgttttccacggtctatgccctggcaggcgaacatattgtcgcgttactaacctcattgccgcaaatacagctactggcggatcggtatcttatctggcaggtggtattaccgctggtgggcgtatggtgctatctgctcgacggtatgtttattggcgcgacgcgcgctgccgaaatgcgcaatagcatggctgtcgccgcgggaggattcgcgctgacgctcttcgccctgccggtattaggaaatcatggtttatggctggcattaaccgtatttctggcgctacgcggtctgtcgttgagccttatctggcgtcgtcactggcgcgagggtacatggtttgccagatcgtgatggttaaaaattctgaatataaaaccgaaggccgaattcctgcctacaattattatcacgtccagcagaaattgcagtgcatttgggcgaataacacctgctattcctaaccgaatgatgaggacaagatgatgaataaagacgaagccggcggtaactggaaacagtttaaaggtaaaatgaaagaacaatggggcaaactgaccgatgacgatatgaccgttatcgaaggtaaacgcgaccaactggtaggtaaaatccaggagcgttacggttaccagaaagatcaggcggaaaaagaggttgttgactgggaaacccgtaacaactatcgctggtaatatgttttcccctatcaggagtacatggatgtgcttcccactgtttgcttatgaatgcgggcgtgcccctctctactgccgcccgtttttccgttcaggctaacgcggttttttcttcaccagcaccgagtgatcgtgaccacagtcgcccggatggcgacacgcttccacttctacgcacgcagggcacagaccgtgcgcctcaataacgttatgtcgtagcgcaaagcccattttagccgccagcgtatgcatgatgtcttccacgccctcggcacactcttccttcaccacgccgcaacgatcgcagataaacatggccgagctgtgcgtcggctggtcgaacaggtggcaaaccacataactattggtggattccactttatggacaaaaccctgttcgagcaaaaaatccagcgcgcggtagatggtgggcggtttggcctgtggttccgtttcgcgcagcaaatcgagcaaatcgtatgcgctgatggcaccctgttgcagactcatcaggcgcagcacttcgaggcgctgaggcgtcaggcgcacgttgcgctgcgcgcagagtttttcagcttgcgccagtaactcttgcgttgtggtcttttccatgtagcacctcgaatggcatgaaagtctaatccgttactttaccacgagctgcttaaaactctgaaattaccccgcgacaatatatcgcctgctaagcttttccgcgccagtattctcatctatacataatgagggtcgatattataacaacaggatttaacatcactatttcacagcaatagttcgcctctgtccggtaaagcgtggcggagggattacttcacctgataataagatgggctaactgtgaacaaaaacgtcaaactttcactgattgctatcgcggtctcgctttttatgacaaagcaggcgggcgccgccaatacctggacggaagcgcgtaatgacgcaatgggcgggacgggcgttgcgtccgcgaattatggcagcggagtactattaaatccggcgttactggcaaaagccaaaccggaagacaatatcactgttgtccttcctgcggtcggcgtccagattacggataaagacaatctccaggatgaaattgacgatatcagcgataaagtggattactacgatgaggtcgtcgataaccttacgctggggcaaattctgctcaatccgcgaggcgtgctgaatcaatttcagggcgccgcgcgcgacctggccgatgagctggaatatctcaacggaaaaaccgcccgcgccaatgccggcgccgggttggcggtaagtattccagggcaaacgctttccgtggcgtttatcgccaaaggttatgcgcatgggcgcgtgagttcgtccattgatcagaacgatattcagtatctgcgcgatatccagcatgatgaacgtgtcgcgcttcgtgaagcaggacgcgctgctttgctggggtctgacgaaattacaaagcatttaaactctaccgcgttggggcgggtagcgattgtatctgactacggtattgcgctggcgaagcagtttgtggtgggcgaggtgcctgtttccattggcgttacgccaaaactgcaaaaaacctggctctataactacaccacctcaatttataactacgacagtagcgactggaatagcagccgttatcgcaatgacgatacgggttttaacattgatgcggggcttgctgccgatatcggtgaaaattggacgttggggctgagcgggcaaaatctggtatctcgcgatatcgatacgaaagatatttacatcactaatggtatgacgggagaaaccaccaactacaaagagacataccaaatccgccccctggttaccgcgggcatcgcatggcataacgatttgctgaccgtaagcgccgatggcgatctgacggaaacgaaaggctttaagagcgaagacaattcacagtacgttggcgtcggcgctgaagttcgaccgttgtcatggctggcggtgcgcgcagggtatcgtgcggatgtgaaaaataacgatagcaatgtggttaccggcggtcttggctttgcgccctttaaccgtgcgcatctcgatttaatgggactgtacggcgaagatgaaacctggggggcaggcgcgcagcttacaatgacattctgaggtgctttcaccggaggcgctacgcttccggtttagcgttatgctatagtaacgccccttttttaaccggatgcttatttattcgccatgcagcctgaaacccagtcctccgctttacctgcttatcgcttctccatcgcgcctatgctcgactggacggacagacattgccgctatttcctgcgtttgctgtctcgccagacgctgctctacaccgaaatggtgaccacgggcgcgattattcacggtaagggtgactatctggcttatagcgaagaagagcatccggtcgctctacagcttggtggaagcgatccggctcagcttgcgcattgtgcaaagctggcggaagcgcgtggctacgatgaaattaacctcaacgtggggtgcccttccgatcgcgtgcaaaatggtatgtttggcgcctgtttgatgggcaatgcgcaactggtcgccgattgtgttaaagccatgcgtgatgtcgtctcgattccggtgacggtaaaaacccgcattggtattgacgatcaggacagttatgcgttcctgtgtgatttcattaatacggtttccggtcagggcgaatgcgagatgtttattatccatgcgcgcaaagcctggctttctggcttaagcccgaaagaaaatcgtgagatcccgccgctggattacccgcgcgtctatcagctaaagcgggattttccgcacctgaccatgtccattaacggcggcatcaaatcgttggaagaggcgaaggaacacttgcgccatatggatggcgtcatggttggccgcgaagcttatcagaattcgggtatactggccgcggtggatcgggagatctttggcgccgataccaccgataccgacccggttgcggtggttcgcgcgatgtatccctatattgagcgtgaattgagccagggagcgtatctggggcatatcactcgccatatgctggggttgttccagggtatccccggcgcgcgacagtggcgtcgctatctgagcgaaaacgtccataaagctggcgcggatgctgctgtactggagcaggcgctaaaactgatagcagacaagcgttaaaagttcgccaaaaattagtcaatctcaccacgctctgcgcagttttgcagggcgttttctttatatatcaaaaacataaatattggcatgatttttgtaatagcttacctgaccaaacccggtaagcgccgtgccgccgggcaatgccatctttatggggagcgactatgctggaactactttttgtgcttggcttttttctgatgttaatggtgacgggcgtctccttgctgggcattctggccgcgctggttgtagcgactgccgtcatgttcttgggcggaatgttcgccctgatgatcaagctgttaccgtggctactgctggcggtggctgtggtgtgggtgatcaaagcagtaaaaacgccaaaaatcccacagtatcagcgcaataaccgtcggttttactaaggtattgagcggttcgtcacaacctggaactttgccgtcacaagcaaataggaatcgattattaaatctgtcatgattgcgcaggtaacgaattcatcgcgctgtaccctatatacagccgaacaaaaaaagaaagggcttcccgggtggaagcccaatttctttgcagagctattacggaatcagcaggcttgagccctgtgtggcccggctttccagcacctcatgcgcgcgacgggcatcttttaacgcatagcgttgattttcagccacatcaactttaatcacgccgctggcgatcaatgagaacaattcattgctggcttcggtcagttcttcacgcgtcgtaatatacccctgtagtgaaggtcgcgtggcatacagggaacctttctgattcagaatacctaaattcacgccggtgacggggccggacgcattgccgaaactgaccatcagtccccgacgttgcaggcagtccagtgaggcttcccaggtatctttccccacggagtcatagaccacgcggacttttttgccgccggtgatctcttttacccgttcgacaatgctctcctcacggtaattaatcacctgccaggcgccggcgtccagcgcccgctgcgctttttgcgcgctaccgacggtaccgataagcttcgcgcccagcgctttcgcccattggcaggcgatcagaccgacgccgcccgcagcggcatgaaacaggaagggttcgtcgggtttcacttcataggttttgcgcaacaggtaaaaaacggtcaatcccttgagaaaagaggctgccgcctgttcgaaagaaatggcgtcaggcaaaatcgcggctttatctgcggggacgttatggacggaactgtaagcgccgagcgttgactgcgcgtagacgacgcgatcgcccacgcgaatgtgcttcacgccgctgccgactttactgaccacacccgcagcttcggttcccaggcccgcaggcaacgacgggggcggatagagtccgctacggatataggtgtcgatgaagttgataccaatggctttgttctcaacctggatttcgtgttccgccggttccgttggcgtaaactccacggtctgaagcacttccggaccaccatgcttgtgaaattcaatacgcgttgccatgcttcctccaaaagaaatgtggtaatctttcgacccaatcactatctcggtaactccattcactatggcaggaaataaacccttcaacaaaccacagactgatgcccgcgaccgcgatccgcaggttgccgggataaaagtgccgccgcactcgattgaagcggaacagtcggtgttgggcggtttaatgctggataacgagcgctgggacgatgtggccgagcgcgtggtggcggaagatttctatacccgcccgcatcgccatatctttacggagatggggcgcttgcaggaaagcggcagtcctatcgacctgattacgctcgcggaatcgctggagcggcagggccaactggacagcgtcggcggtttcgcctatctggcggagctgtctaaaaacacgccaagcgcggcgaatatcagtgcttatgcggacattgtgcgcgaacgcgccgtggtccgcgatatgatcgcggtggcgcatgaaattgcggacgccggttacgatccacaggggcgcaatagcgacgaactgctggatctggcggagtcgcgcgtcttccagatcgcggaaaaccgggccaacaaagacgaaggtccgaaaagcatcgaccagattctcgacgccaccgtggcgcgtattgagcagttgttccagcaaccgcacgatggcgttacaggcgtggataccggctatcaggatctcaataaaaagacggcaggattacagcgttcggatttgattatcgtcgcggcgcgtccctccatgggtaaaaccacttttgcgatgaacctctgcgaaaatgcggcgatgttgcaggataaaccagtactgatcttcagcctggagatgcccggcgaacagatcatgatgcgtatgctggcctcgctgtcccgcgtcgatcagacacgtattcgtaccggtcaactcgatgatgaagactgggcgcgaatctccggcacgatgggcattctgctggagaaacgcaatatgtatattgacgactcctcaggtcttacgccgacagaagtccgttcgcgcgcgcggcgtattttccgcgaacatggcgggttaagtctgattatgatcgactacctgcaattgatgcgtgtgccgtcgctttctgataaccgtactctggaaatcgccgaaatttctcgctcgttgaaagcgctggcgaaggaactccaggtgccggtcgtggcgctatcgcagcttaaccgctccctggaacaacgcgcggataaacgtccggtgaactccgacctgcgtgaatccggctctattgaacaggatgccgacttaattatgtttatctaccgtgatgaggtttatcacgagaacagcgacttaaaaggcattgctgaaattattattggtaagcagcgtaacggtcctatcggtacggttcgtctgacgttcaatggtcagtggtcgcgcttcgataactatgcgggaccgcaatacgatgatgagtaactctccgtcattcttttaacaaggaattcaaatgcaagcggcaacagtcgtcattaaccgccgcgctctgcgacacaacctgcaacgtctgcgtgaactggcgcctgccagtaagctggttgcggtggtgaaagcgaacgcttatggacacggtcttctggagaccgcgcgaacgctccctgatgctgatgcttttggcgtggcgcgtcttgaagaggctctacgtctgcgagcgggcgggattacgcagcctatcctgctgctggagggttttttcgacgccgccgatttgcctaccatttccgcgcaatgtctgcataccgccgtacataatcaggagcagcttgccgccctggaggcggtggagctggcggagccggtaacggtctggatgaagctggataccggtatgcatcgtctcggcgtgcgtcccgaagaggcggaggcgttctaccagcgtctgacgcactgtaaaaatgtacgccagccggtgaatatcgtcagccattttgcccgtgcggatgagccggaatgcggcgctaccgaacatcagctcgacatttttaatgtcttctgtcagggtaaacccggtcagcgctctattgccgcgtctggcggtatcctgctgtggccgcagtctcactttgactgggcgcgtccgggcatcattttgtatggcgtatcgccgctggagcacaaaccttgggggccggattttggttttcagccggtgatgtccttaacttccagtttgatcgcggtgcgtgaccacaaagcgggcgaaccggtgggctacggcgggacatgggtgagtgagcgcgacacgcgcctgggcgtggtggcgatgggttatggcgatggctacccacgagcggcgccttccggtacgccagtactggtcaatggtcgtgaagtcccgattgtcgggcgggtggcgatggatatgatttgcgtggatttggggccaaacgcgcaggataacgcgggcgatccggtggtcttatggggtgaaggtctgccggttgaacgtatcgctgaaatgacaaaagtaagtgcttacgaacttattacgcgcctgacctcaagggtggcaatgaagtatattgattaaatgcgcggcgggccgggtggcgcttgcgcttatccggcttgtatcgcgcatgggctgcaggccggataagacgttcacgccgtcatccggtaatatgcgcatccaccacaacatcctctcgatcttctcgtccttccggtttattgtgttatttcctgccctctgtaaacctggagaaccatcgcgtgtttcaaaaagttgacgcctatgccggcgatccgattctttcactgatggagcgttttaaagacgactcccgtcacgacaaagtaaatctgaacattggcctgtattacaacgaagacgggattatcccacagctcaaaacggtggccgaagccgaagcccggcttaacgcgcagccgcatggcgcctcgctgtacctgccgatggaaggactcaatacttatcgccatactatcgcgcctttgctctttggcgccgatcacccggttcttcagcaacagcgcgtggccactatccagacattaggtggttcaggcgcgctgaaagtgggcgcggattttctgaagcgttatttccccgacgcaggcgtatgggtgagcgaccctacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgctgctgcacccctgttgtcacaacccgaccggggcggatttaacgccttcgcaatgggatgcggtgattgagatagtgaaagcgcgcgatctgattccgttccttgatattgcctatcaggggtttggcgcaggcatggacgaggatgcttacgctattcgcgccattgccagcgccgggttacctgcgttagtcagtaattctttttcgaagattttctcgctgtatggcgagtgcgtcggcggcctgtcggtggtgtgtgaagatgccgaaatcgccgcgcgggttctgggacagctaaaagcgacggtgcgccgaatttactccagtccgccgtgtttcggcgctcaggtggtcgctacggtcctgggcgatgaggcgttaaaagcgagctggctggcggaagtcgacgcgatgcgtacccgcattatatcgatgcgccagacgctggtgaaagagctgaaggcggagatgcctgaccgcaacttcgattacttgttacagcagcgtggtatgttcagctataccgggttaagcgcggagcaggtcgatcggttgcgcgatgagtttggcgtttacctgattgccagtggccgcatgtgtgtcgctgggcttaatgcttcaaatgtacaccgcgtggcgaaggcatttgccgctgtcatgtaatattcaggccggacggcgataacagtgctctccggtctgacaatagctgttgtgatcatcctcttttttcgtaacaaaaccgcaaataatccttccttttgaccgttactggcgttatggtcagatagttttttgaccaaagactcatcttaataattataatattttgaattttaagggaaaagcatgaaaaaaataaccctggcgctgagcgccgtctgtttattgtttacgctaaaccattccgcgaatgcgttagtatcttccccttcgacgctcaatccgggcactaatgttgcaaaactcgcggaacaagcacctgtccattgggtctctgtcgcccagattgaaaacagcctgaccggacgcccgccgatggcggtcggctttgatattgacgacaccgtgttattttccagccccggattctggcgcggaaagaaaacctattccccggacagcgacgattatctgaaaaatccggccttttgggaaaaaatgaacaacggctgggatgagttcagtattccaaaagaagtggcccgacagctcattgatatgcatgttcgccgtggcgacagtatttactttgtcactggtcgtagtcagacgaaaacggaaactgtgtcgaaaacgctggcggataacttccatattccggcggcgaatatgaatccggtgattttcgccggcgataaaccgggacaaaatacgaaagtccagtggctgcaggagaagaacatgcgtatcttctacggcgattcggataacgatattaccgcagctcgtgattgtggtatccgcggtattcgtatcctgcgcgcggctaactccacctacaaaccgctgccgcaggcaggagcgtttggcgaggaagtcattgtcaactcggagtactaaaaatcaggagagcgacaggctctccttttttgcatgatttttgcacaaacttgccccgctggcttttaccttttccagacttgctgcacactattcaggagacgtttgtttttaggaaggagcagcctatgtggtatcagcgcaccattacactgagcgagaagccgcgcgggtttcatctaataacagatgaaattaccgataaattgtctggcttaccgcctgtcgaaacgggtttgctgcatctgttgttgctacatacctcggcctcgctgacgttaaacgaaaactgcgatcccaccgtgcgcgctgatatggagcgccatttcctgaaaaccgttcccgataatgcggcgtatgaatatgattacgaaggggcggatgacatgccttcgcatattaagtcgtcagtattgggcgtctcgttgctgctgcctgtacgccaggggcgtttacagttaggaacatggcaaggtatctggttgggagagcaccgtattcacggcggtccacgtaaaatcatcgcgacactacaaggggaatgataatgaccatttcggaattactgcaatactgcatggcaaaacctggcgcagagcagagcgttcacagcgactggaaagcgacgcaaattaaagtggaagatgtacttttcgcgatggtaaaagaagttgatgggcgcccggcagcctctctcaaaaccagcccggaactggcagagttgttacgccagcagcacagcgatgttcgatcgagtcggcaccttaataaagcgcactggagtacggtctatctggacggctcgctgccggattcacaactctattatctggtcgatgcctcttatcaacaggcggtaaatgcgctgtcggaagataaacgcaagcagttgccgcagtcctgattatagcgcgccgaccaacaacgccagggcgatatcaatgaggtggatgaccgtagaccggatacggctgccgagggcaatttgcgcattattggcgcgtagcctggcgaggtcccgctgtccttccagcagaataatcatatcgtcgtcgtccagccagccgcgagcatgttcctgaagcgcgcgggcgataaacgcggcggactcgcggataccgtcgtcgctgtcttctcttgcctgcttatacgtctggataaactcggcaattgccgaggaggctacaggatgttcggcccgggcggcagtaaacaggttacgtatttcgttaatagacgccattttcttctccctgagtgcagcgggcgccccaatgcagacactcaccctgtatggctaatttccagacctgattattttgctgttggtatctctcagcctggatgtaagtaagtggttgcttacatttcataacccgcgcataaagacgcaaatagtgatttttcagcagcgccagattatcgagtcggtgtttatccccaccttgacgggcgacccgctcagcctgaaaaaatgtctggcggatatcgcggtcatctttgagcagtgtctctttttgccacggtattcgcgccgcgtcctgcaggaagcgggttgagcgcgcttgtaatagcgtcagttgttgaaaagccacggcgctaaagcggtcaggcagcgtacaggcggctaaaaacaggcacagcagtagtgtgattgcgtagggcaacttcatggtgttttccataacagaccgtttgcgctatcacatgtcagagcgaggcggcacgcaaatcacaaatgctcaacacggatacaatgaggtgggatgaggaaaaatgatgccgcttcccggcgaatcggaaagcggtgtgaaggttatttgagcataggtttaaggaagcgggcggtatgcgacgcctcgcactccgccacggtttccggcgtaccggcgacgagaatttcgccgccgccgctgccgccttccgggccgaggtcgacaatccagtccgccgttttaatgacgtccaggttgtgttcgatcaccacgatggtgttgccctgatcgcgcaactgatgcagcacgtcaagcaactgctgaatatcggcaaagtgcaggccggtggtcggctcgtcgagaatatacagcgtctgcccggtgccacgtttcgacagttcgcgcgccagcttcacgcgctgggcctcgccgccggaaagcgtcgtcgccgactgaccaagacggatataggtcagccccacgtccatcagcgtctgcagcttacgcgccagcgccggaaccgcatcaaagaactcacgcgcttcttcaatggtcatatccagcacttcgtggatggtcttgcctttgtacttaatctccagcgtttcccggttatagcgcttgcctttgcactggtcgcacggcacgtaaatatccggcagaaagtgcatttcgactttaatgacgccatcgccctggcacgcttcgcagcgaccgccgcgcacgttgaagctgaatcgccctggcgtgtagccgcgcgagcgagactccggcacgccagcaaaaagctcacgaaccggggtaaagacgcccgtataggtcgccgggttggaacgcggggtgcgctcgatcgggctctggtcgatatcgatcactttatcgaaatgttccagcccctgaatatcccgatacggcgccggttcggcgatagtcgccccgtttaactgacgctgggcgatggggaacagcgtatcgttaatcagcgtcgatttaccggaacccgagacgccggtgatacaggtaaacagccctaccggtagcgtaagggtcacatctttcaggttgttgccgcgcgcgccggtgagtttgagcactttttctggatttgccggcacgcgttgtttcggcacttcaattttgcgtttaccgctcatgtactggccggtcagcgattccggtaccgccataatggcttccagcgggccttccgccaccacctcgccgccgtgaacgcccgcgccggggccaatatcaatcacatggtcggcggcgcggatggcgtcttcatcgtgttccaccacaatcacggtattgccaagattgcgcagatgaatcagcgtacccagcagccgttcgttatcgcgctggtgcagaccgatggacggttcatccagcacatacatcacgccgactaacccggcgcctatctggctcgccagacgaatacgctgggcttcgccgccggaaagcgcctctgccgagcgggagagcgtgagatagttcaggccgacgttcaccagaaacttgaggcgatcgccgatctcttttagcactttttcggcgattttcgcccgttgcccggaaagcttgagattagtgaaaaaatccatcgcatggccaatgctcatatcggaaatagcaggcagcggcgtattttccacaaatacatggcgcgcttcgcgattcagtcgcgttccttcacagctggcgcaggggcgattactgatgaatttcgccagctcttcgcgcaccgcgctggattccgtctctttataacggcgctccatattatgcagcacgccttcgaacggatggcggcgcacggaggtatcgccgcgatcgttcatatatttaaattcgatgttctctttgccggaaccgtacagcacgactttgtgtacgttggcgctgaggcttgcccacggcgcatccacgtcgaacttatagtgttccgccagcgacttgagcatttgaaagtagtaaaaattgcgacgatcccaaccacgaatcgcgccgcctgccagcgacaggtcgggattctggatcacgcggtccggatcgaaatattgctgaacgccgagcccgtcacaggtcggacaggcgcctgccgggttgttgaacgagaacagacgcggttccagctcgcgcatactgtagccgcaaatcgggcaggcaaaattggcggagaacagaagctcctccgctttctcatcgtccatatcggcaacaaccgccgtgccgccggataattccagcgccgtttcgaacgactccgccaggcgttgggaaagatcgttacgaactttgaagcgatcgatcaccacctcaatggtatgtttcttttgtagctccagcttcggcggatcggagagatcgcagacttcgccgtcaatacgggcgcgaatgtaaccctggcttgccagattttccagcgttttggtgtgttcgcctttacgctctttaataatcggcgccagcagcatcaggcgtttgccttccggctgcgacagcacgttatcgaccatctggctaacggtttgcgctgccagcggcacgtcatggtccggacaacgcggctcgcccacgcgggcaaacagcaggcgcaggtagtcgtggatctcggtaatagtacccaccgtagagcgcgggttgtgcgatgtcgatttctgttcaattgagatcgcgggcgatagcccctcaatatggtcgacatccggtttttccatgagcgacaaaaactgccgcgcgtaagcggagagcgattcaacgtaacgacgctgcccttcggcatacagagtgtcgaaagccagtgaggatttgcctgaacccgaaagcccggtcacgacaatcagtttgtcgcgggggatgacgaggttaatatttttgagattatgggtgcgggcgccccgaacttcgatcttatccattcacctttcccggtagagactcggatgcctggtttgtttgaaggacaaacggcagaaacggctaattatgacacaatttaacctgtttgaatatacagtattggaatgcatcttcagctaaagtatgcaacaatatgaggttcgcgcgagtgacctggaacctgcatcgcagctattaaaatgctacgtggaaatggtacactcacgcgtttacactatttatgaaacgtattcaggagactcaattatggccagcagaggcgtaaacaaggtgattctcgttggtaatctgggccaggacccggaagtacgctatatgccgagtggcggtgctgtcgccaacttaacgctggctacttctgaatcctggcgcgataagcagaccggcgaaatgaaagagcagactgaatggcaccgggtggtgatgttcggcaaactggcggaagtggccggcgaatatctgcgtaaaggttctcaggtgtatatcgaaggtcaattgcgtacccgcaagtggaccgatcagagtggccaggaacgctatacgactgaaattaacgttccgcagatcggcggcgtgatgcagatgctgggtggtcgccagggcggcggcgcaccggcaggcggtcagcagcaggggggttggggtcagccgcaacaacctcagcagccgcagggcggtaaccagttcagcggcggcgcgcagtcgcgtccacagcaatccgcgccagcgccgtctaacgaaccgccaatggattttgacgacgacattccgttctgatttttggtaaaaaactcaaagcgttatttgcattttcgctatagttctcgtctgctgaaatgcctggtgtaaaccaggcattttattacctggtattattgtcttagtatccctttcaaaaaagagaagcgcatatctcacggaatgacttacggaaaaatgtcgcttatcgcctctggccgactcgcctcggcacatcattatccagccgaagttcataaatgtactgcaataacccggattgtcttaaatatgaaagagaaatctcatctgcaaaatatataatttatagccattttttgacaacaaaaagatattataaaataacggtagagaatggtcggtattatcaatagttaattaaatgcttgctttagcttgtgatgagctcaaatatgatatgtgtatcttgctttatttttaattgctgaagataaaattgttacttatagctggctttatataaaaaatggttttatttgtgtatttttttacacaattctgattttttactccccacttattatattttcaatgatttaagttatattgaagtccctatgaccctatgttttaattgtgaaaattcattttatcctctggaggcaaatttattaaatacgtatggttataacgcgtattaaaaagaaatatgtccttaaaatgatttagagtttcaatgattagctaacaaatctatttatcggcgggtggttttaatttgctgatgactattttttatttatgagctgagagcttatgcgatacctattattggggaagatatagttagtgcaataattgatgtctacctaattaaaaaaatgaagagtgtttttaattaaagcactcatctttgttgtgggcgcataaaaatggcgtcgttgtttttatttttctgattacgagatgtaagaaaactgaaatctataaagcgtattggtagcaggaagccaagggtggtagcgttcactttctgaataagttgagcatcctttatcctttctaatccacaaaaacattttattcacaatgtaatatcaggagacaacatggaagacgaaagtaatccgtggcctagttttgttgatacattctctacggtattgtgcatttttatatttcttatgttggtgtttgcacttaataatatgattattatgtatgacaactcaattaaagtttataaagcaaatatagagaataagactaaatctactgctcaaaatagcggagccaatgacaattcaaatgctaatgaaatagttaataaagaagtgaatactcaagatgtgtcggacggaatgactacaatgtcaggtaaggaggttggagtatacgatatcgccgatggtcagaaaattgatataacatctacaaaaaatgagcttgttattacgtatcatggcaggctgagaagcttttctgaagaggatactcataaaatagaggcttggttagaagacaaaactaatagtaatttattgatagaaatggttattcctcaggcagacatctctttctctgactctttacgactgggatatgaacggggaattattttgatgaaagagattaagaagatatatcctgatgtagttattgacatgagtgttaactccgcagcatcaagtacaacgagtaaagctattatcacgactattaataaaaaggtgtcagagtgaaatatataaatcattatcgctatttgtttgtctgttttttccttgccatactcccttttttcgctttatcttttcccggtataagagagtatgtttttgataattttatggtttctgcaatttacaatggagtcattattgccatttatattacaggttctttgtgtgcattattcactattcttaaaaatatttcagcaaaagacatattaatagctcaggacgccagtagaaaaaatagcattctttctaacctcaatcaggttttgtttgccggggaacccaaacagtgtgatttcaatttactgatggaattagatgacaatgtgtctaccgcccgtaaccaacgattgtcatttattatgagctgtagcaatgtgtcgacgcttgttggcctgttggggacgtttgcgggtctgtctattacgattggttcaatcgggaacttattgagctcgccatcagatgttggcggtgataatgcaagtaatacactcaatatgattgtgacaatggtagcgtcgctttctgaaccattgaaagggatgaataccgcatttgtatcttctatctatggtgttgtttgcgccatactcctgacctcacaaagtgtttttgttcgcagctcctattcccttgtttctacagagatcaaaaaattaaaaatcataagtaacagatccaataataaacaacgaagcctgcgggttgaatcagagacgcttgtagaatttaaagagttgtttaaagcgttttttgataactacctgacagttgaaaacttacggacgcaggatgaagaaaagaaacgagtgatgctatcagatagctttgtcactttgcaaaaccgactattggataactcagcaaaactggaacaactttctacgctgattgatggttatctggtaagcaataacgaaaataccaaaaaattagttgacggtgtaataacaattacctctcgtttatctgaaggtaataccctgcttgctgataataatgcacgactggaggcaatgagtacaatacaaaatattatagacaaaaagaatgattcaataatggcatcagttgataaatgttatcaggaatctttttcacatggtaagaccataaacgatattgccgctggcagtgccgatatttctcatactctcgatgggctgagaaaagaaatggatgaggatatgaataatgttcatttagcgctatccgatctatcggctactgataaaaagattattgccaatactaaagagattagtgctgaaatggttagctatcgtgatacctatatgccattaatggaaaaaataacatctatgcatcaggaaatagtaaagcaacgtttgttaaacaaggaggaaaaaaatgaagattaagatgttttttctgacgactgcttttattacacaaagcacatacgccagcgagcttccggtcattcctctaagagatttagttaatgccgcattaacgcatcagccctctgttgctgtttcatattatgagactgaaaagaaaaacagtgacttagatctttcacgggcagcactttatcctaccctggatctaacctctggccttaataataacagaaaggagtcgtcaggtaccgagagaaacgttgaaaataaggtatctttatcataccgaataacggattttggagtgaggggggctaatatcaggaaatctgaatacgaaagagataatagtaaaactgactatgaaaaaacaaagaatatagtgtctcaggaggttgtgacaacctattacaacatcagtaaatatcgtgaaatgattgatggcgtaaatctggagaaagagttttataaaaagatgctggaaactttttcgctactggtatcttccggtgtagctatgcaatctgatatgcgtaaagtacaagtatctatcgatgcattaaataccagaagtattatgtatcagtcgatgctggatgatgaaatgtataaaatgcagaatatgactggtctgaatttatcaccagatcagattcaaagcgatgaaaaattcaacctcttcaaaaaatatatctttgtcgaaagccctgaaaaacttatggacatggtgatgaaatacaacgatgactataagatgcttgtcaatacccgaaaagctgcgaccgaagatattaatgccgcaaaatcatcctattttccgactgtagatctcgtttccagctatgtacagaataatccgagcggtagtgccaaaaaaagtgattatgaagatgaatttaaaacgggtatcaatgtcagtttcaacatttttaatgggtttagaaatgcagcccaggaaagaaaaatggtggcaagttactcgcaggctaagctgcaaattgacgatttcttgattaaaactcgttataacattgattcacaactttcaaaatacaccgctgcaaaagagacttactcagtggcggaacgttcacatacaaacgcgttacagcttactgaattatatgagcaggagtttcagttagggcaaaaaagtttgcttgatttaatttcaagccgtaatgaagcatttcaggcatatgtaagcatgatcgacagcaaatatagcctgtatattttaaagctacagcaactctcattgatttttcatttaatggattatttaaaaagtgagttaaatgtaatgaaatgaatagaagacaaagcgatcatctcatgatgataattatttctttgacgatcttaattattatccttacctactttatagaaattaattcagtggttcatggtcagggtgttatcactactaaagataatgctcagttaatatctctttctaaaggagggacgatacaagatatttatgtggccgagggggatactgtaaaaaaaggagaactccttgcaaaggtcgttaactttgatctgcaaaaagaatatcaaaggtatagaactcaaaaagggtatctggataaagatgttaacgaaatatctttcattcttgataaagaaaatgagagtggattgattaccctggatggcacccgttctttaagcaacaaagaggtaaaagcgaatattgaattagtgcatagtcagataagagctaaagagttaaaaaaaacctctcttgattctgagattagcggattacaagagaagctaagttcgaaagaaaaagaactagcattgcttgccgaagaaataaatattctttctccactggtaaaaaaaggaattagcccatataccaattttcttaacaagaaacaggcgtatataaaagttaagtctgaaattaatgatattgaaagtagcatcactttaaaaaaagatgatattgagctggttgttaatgatattgaggcgcttaataatgaattgcgattatctttatctaaaataatatctaaaaatcttcaggaacttgaggttgttaactctacattaaaagtaatagagaagcagataaatgaggaggatatctattcaccggttgacggtgtaatttataaaatcaataaaagtgccactactcatggtggtgtgattcaggcggcggacttactttttgaaataaaaccaaaagtaaggactatgctggccgatgtgaaaatactaccaaaataccgtgaccaaatatatgtagatgaagccgttaagctagatgtccagtcaattattcaaccaaagataaaatcgtataatgcgactatcgataatattagccctgactcttatgaggaaaataccggaggaacaattcagcgttattataaagtaattattgcattcgatgttaatgaagatgatttacggtggttaaaaccaggtatgactgttgacgccagtgtaattaccggaaaacacagcattatggaatacctgttatctcctttgatgaaaggcgtggacaaagccttttcagaaccagttaatactaaacgattagatacaccttgagagtgaatataatattatgggaaataaaagcatacaaaagttttttgccgatcaaaattctgtaattgatttatcttctttgggtaatgccaaaggcgcaaaagtttctctttccgggccagacatgaacattaccacgccgcatgggtcagtgatcattgtcaatggcgctctttattcaagtatcaaaggcaataacctcgctgttaaatttaaagataagactattaccggcgctaaaattctgggcagcgtagatttaaaagatattcaactggagagaattgacagctcattagttgattctgctcaggtagaaaagaaaggtaatggcaaacgacgaaataagaaggaagaagaggaattaaaaaagcagcttgacgaggctgaaaacgcaaagaaagaagctgataaggcgaaggaagaagcagagaaagctaaggaggcagcagaaaaaacgctcaatgaagcgtttgaagtacagaactcgtcaaagcaaattgaagaaatgctgcagaactttttggctgacaatgtagcaaaagacaatctggctcagcaaagcgatgcttcccagcaaaatacacaggctaaagcaacgcaggcttctaaacagaacgatgctgaaaaagttcttcctcaacctattaataaaaataccagtactggcaaaagtaatagcagtaaaaatgaggaaaataagctcgatgccgagtctgttaaagagccgcttaaagtcacattagcgcttgcggccgagagtaacagcggtagcaaagatgatagtataactaattttaccaaacctcagtttgtaggtagcactgctcccaatgccacggttattattaaaattaatggtattgctgtcggtcaggctgtagcggatagtttgggtaacttcaccttcacagcgcctgaaacattgactgatggaacatacaatctggaggcagaggccaagactgctgatggaagcggtagcgccaaacttgtcattactatcgattccgttaccgataagccaacatttgaactttcgcctgaaagtagtgtgtccggtcataagggcttaacgccgaccttgacgccttcaattgttggtacggcggaagagaatgctaaggttgacatttatgtagataataaactggttgccagcgttgatgtcgataaagatggaaactggagttatgaatttaaagataatgaattatctgagggcgaaaatagtataaaagtcgttgccgtggataaagcaggtaataaaaacgaaacgacggatagtatcataaccgacaccattcctccggaaaagccgacgattgagctggatgatagtagtgattccggcattaaaaatgacaacattacaaatagcactctgccaacatttattggtgtggcggaacctggttctacagtctctatttatcttgggcttaaacatcttggtgaggtcattgttgctaaagatgggacatggagctatacgcttactacgccgctcaaggatggcgaatacaatataacagcaaccgctactgatattgccgggcatacctctgcgacggcaaatctgccttttactattgatacccgtatcagctatttcagcgctgagattgaaacgactgatgatagcggtattgttggagataacgttactaacaatactcgcccaacctttacaggtaaaactgagccaaatgctattatcagtgtcataaatagtgagactggcgaagaggttatttttaaagcgaatgacaagggcgaatggacgttcaatttcacttcagactcagtggaaggggttaacaatcttacgttcactgttgaagatgtcgctggcaacaaaaaggatttttcctttagttacgttatcgatactgttgcccctgtacctccgacggtttctttggaggattttgttgttttaccgaatggtataattttatcagggaatgatttaccggctttagtcggtacggcagagccaaagtctaccatcttattgatgcgagatggtaaattatatgacagcattgaggttgactcaaacgggacctggaattatcagtttagtaataaatttcttcagggcgcctatgatattgaaatcatttctcaggatgccgccggtaataaatcctctactgttaaatattcttttactattcaaactgaagttgtacctccaaaagcggaactcgatgccagtgatgattccggtgcaaaaggcgactggattaccaataaacataatgctctgacattactgggaacagcggataggtttgctaccataaatatccttatcgatggtaaaacgataggcgtgacgactgcggatgcagacggtaactggaattttgatatttcccgaaatctgtctgacaatgtttataagattacggttgaatctatcgatcctttaggaagaacgtcatctgtagattatcagcttaccattgatagctttacgccgatccctactgttatgttgcatgatagcgctggctctggcgttaaaggcgatatgattactaaaattaatacgccgttgtttaccgggatggctgaagctaatgctaaggtttccatctatgttgacggtgtgttaagtggcgaggctattgctggcgatgatggtgtatggaattttcaatttaccacagcgttgtccgatggctcgcatgacgtaacggtaaaggtagaagatattgccggtaatactgcctcctcatcagcgtataatttccaaatcgtaacgcaaacgcaaaaaccaacaatagagttggtcaacgatacgggggttgataatacagaccatattattaatgaaaagaatcctgcactgacagggaccgctgcaccctattcaacggttaaactctatgttgatggcgcactaatcgctgaggtcagaacaaataaagatagcagatgggagtataccctgaaagccgatcaaggtttggttgatggcgatcatagaataaccgcttcagttgaagatatcgctggcaacattgcgcattcggatcctttcttaattagcgttgatactgctatttcaataccgatagtttcattgagcccggattcagattcgggaatcgcagatgataatttaacgaatatcgttaaccctaccttgcacctaaaagatattgatccggacattatcagcgttcaggtatgggatgccgcgtctgatacgcagatcggtgttgccacgcaacaacctgatggttcatggacctatacctttacttcagatttaacggaaggcttgcatcaggtttatgtcaaggttgaggacattgcgggtaataaagcgaacagcgcggtattcgattttactatcgataccacagtatcaacgccggtgatttccctgctttctaaggatgatacgggggtgacaggcgataacctgaccaatatcaataagccaggttttgctatttccggtgttgatgccgatgcgcatcgggtcgtcgtacaggtgatgcacaatggcgtgagcgaagagatcgaactttcccacctcaatggtagttggttatttacaccagggaatacgtgggcggatggcagctacacgttaacggtgaaagtagaagataaggcaggaaataccagctattcagcgccgctgacggtcgttatcgatacccaaatcgccattgatggggtggaactggtcaacgatagcggcgtgaaaggcgacaatatgaccaacgacgaccgtccccactttcgtgtgacggtacctacggatgtcaatgaagtccgtctgagcattgacggtggtaattcgtgggttcaggcaaccccgggcgtggcaggaagctgggagtatatctggccgacagacctggcagatggtcaatacacgctaacggtggaagcgactgataaagcaggcaatacagtgacgaagaccatcgatttcgcggtggataccacgctgtcagtgccggtcatcgtactgaatagcgcggacgataccggtgtccagggcgataacatgacgaatcgcacccagccgacatttgccctgcagcatattgatgatgatgccgttcgcgttacggtcagcgtggagcatggcggcgtcaccaccacatttgacgccacgaaaggcacaggcggatggacctttacgccgccgacatcatgggcggatggtgattataccctgagtgtgtcagtcgaagataaagcggggaacaccagccattctgcatcgctgacggtgacggtggacacgcaaatcgccattaataacattgaactggtcaatgacagcggtattcccaacgataatctgactaataatgtgcgtccacacttccaggtgacggtaccgacggatgtcaacgtggtgcgcctgagcattgacggcggcaagacgtggttcaacgcgacccagagcgcgacgccgggcgtctgggattatatctggccggatgatgtggccgacggaggctataccctgacggtagaagcgaccgatgaggcgggaaataaggcaacacagacgctcgatttcaccatcgataccactctgtctgtgccgaccctctcgctggacagcgcagatgacagcggcatcgcgggcgataatatcaccagtgttaaaacgccgggctttaccctcaacaatattgataccgatgtcagccgggtgatagtggaggtaatgcacaatggcattaaacaggaggtaccactggttcagaccggcggacagtggcgctttgcgccgaccagcgactgggcggacggcggctatatcctgacggtgaaggtagaagacagggccggaaatgtgaagcagtccgcgccgttgacggtgacagtggacacgcatatcgccattgaccgtattgaactggttaacgacagcagtatccccgacgataatctgaccaatgaagcgcgcccgcactttcaggtgacagtaccggcggatgttaacggtgtaagactgagcattgatggcggcaaaacgtggtttgacgccacgcagagcgcgacgtcgggcgtctgggattatacctggctgacgaatgtggctaacggccctcacaccctgatggtggaagcgaccgacaaggcgggaaacaaaacgacgcagaaactggacttcatcatcgataccctgctgtcagaaccgattattaccctggacagtgcggatgacagcgccgctggcgataacatcaccaacgttaagatgccaggctttaccctcggtaatatcgacgccgacgtgaccaaagtggtggtgacggtggcgcatgatggtaagaaccaacagatagagttgattaagaacggcggtgtgtggcgctttacgccgggcgcagcctggaccgatggcgactatacgctgacggtaaaggtagaagataaggcgggtaatacaaattattctgcgccgctgacggtgactatcgatacgcaaacgtctattgatcgcattgggcttcttaatgacacgggtattgtcggggataacctgaccaatgaagcacgtccacagtttcatattacggtaccgacggacgtgaactctgtgcaactgagtcttgatggcggcatcaactgggttaacgcaacgctgacgtctgacggcgtttgggagtatatatggccgacagatctggtcgaaaatacgtataccctgacagtgaaagcaaccgatgttgcaggcaacacggcgacggaaacgctcaattttatcattgataccacattgtcgacaccgaccatcacgctggatagcgcagatgatagcggcaccgccaacgataataagactaacgttaaaacgccgggttttattatcggcggtattgattctgacgtgactcaggtcgtcgtgcaggtgatgcgcgatggtcacagcgaggaggtggagctgacgcagactaacgggcagtggcgttttgtacccggcagcgcgtggactgatggcgactatacgctgacggtaacggtgaaagatgaggcgggtaatattcgccactcagcgccgttgacggtcaccatcgatacgcaaatcaccattgaccatattgaactggtcaatgacagcggtattcccgacgataatctgactaataatgtgcgtccgcacttccaggtgacggtaccgacggatgtcaacgtggtgcgcctgagcattgacggcggcaagacgtggttcaacgcgacccagagcgcgacgccgggcgtctgggattatacctggctggctgatgtgggagagggtaagcataccctgacagtggaggcgaccgacaaggcgggaaacaaaacgacgcagcaactggacttcatcatcgataccctactgtcagaaccgactatcgtgctggacagcacggacgacagcggaacaaaaggcgataacctgaccaacgtaaataagccgacgtttttactgggcaatattgacgcagacgcgcggtatgtcacagttgaggtacagcatggcggcacgaaagaggtgctgacggccaccaaagacgcgaccggcaactggagcgtgacaccgatcggcacatgggcagatggcgactatacgctgacagtgagggtggaagatgaggcggggaacgaaaaacactcagcgtcgctgacggtcactgttgatacccaaatcaccattgatgttattgaactggttaatgataacggtattcccggcgacaatatgactaacgacgcccatccgcagttccgcgtgacggtaccgggggatgttaacgaagtcagtctgagcattgacggcggtgtaacctgggttaaagcgatgcaaagcgcgacgccgggcgtctggaattatacctggccaaagacagtggcagatggtgactacacgttaacggtgaaagcgactgataacgcaggcaatacggtgaccaggacgctcgacttcactattgatactacgttgtcgacgccggttatcgtactggatagcgcggacgacagtggtgtccatggcgataacatgaccaatcgcacccagccgacatttgccctgcagcatattgatgatgatgccgttcgcgttacggtcagcgtagagcatggcggcgtcaccaccacatttgacgccacgaaagacgcaggcggatggacctttacgccgacaggggcgtgggcggatggtgattataccctgagtgtgtcagtcgaagataaagcggggaacaccagccattctgcatcgctgacggtgacggtggacacgcaaatcgccattaataacattgaactggtcaatgacagcggtattcccaacgataatctgactaataatgtgcgtccacacttccaggtgacggtaccgacggatgtcaacgtggtgcgcctgagcattgacggcggcaagacgtggttcaacgcgacccagagcgcgacgccgggtgtctgggattatacctggctggctgatgtgggagaggggaagcataccctgacagtggaggcgaccgacaaggcgggaaacaaaacgacgcagcaactggacttcatcatcgataccctactgtcagaaccgactatcgtgctggacaacacggacgacagcggaacaaaaggcgataacctgaccaacgtaaataagccgacgtttttactgggcaatattgacgcagacgcgcggtatgtcacggttgaggtgcagcatggcggcacgaaagaagtgctgacggccaccaaaggcgcgaccggcatctggagcgtgacaccgaccggcacatgggcagatggcgactatacgctgacggtgagggtggaggatgatgcggggaacgtaaaatactcagcgccgctgacggtcacggttgatacccaaatcaccatcgatgttattgaactggttaatgataacggtattcccggcgacaacctgaccaatgatgttcgtccacacttccgcgtcacggtgccaggggatgtcaacgaggtacgtctgagtatcgacggcggtaatacgtgggttcgtgcaacacagggcacggcagggatctgggattacacctggccgaaagatgtgaccgacgggctacataccctgacggtagaagcgaccgataaggcgggaaataagacgacgcagacgctcgattttaccattgatacccggctgtcaacgcctaccatcgctatggacagcagggacgatacaggtgccattggcgatcatattacgagcgtcaaaagaccgggctttaccattggcaatattgacgccgatgcgcactcggtcattttgcggatcacacagggcggcaatagccaggaagtgacactaacccaggttggaggacagtggcgctttacgccagatgctgactgggcggacggtagctatacgctgacggtagaggtaacggataacgcaggaaacgttcgtcagtccacgccgctggtggtgacggtggacacgcaaaccagcattactgatattacattggtcaatgatcatggcgtgcctgatgacaatctaactaatagcacccgtccgcagtttgagatcacggtgccggcggatgtgaattctgtgcaactgagcattgatgggggcgcaaactgggtgagcgcgacgcagggtatcgaaggcgtctggggctatacctggccaacggatatgggcgatggaaaacacaccctaaccgtcatggtcaccgacagagcgggcaatacggcgacgcaaacgcttgaatttttcatcgacacccggttgtcgacgccgaccattgcgctggatagcacggatgataccggtacgcctggcgatgatatgaccaatcgcacccggccgacttttattctgcagaatatcgattcggatgttatcaacgttacagtcagcgtcacgcataatggaacgacaacctcgtttaccgcgacacagggggctggaggatggagctttacaccgccagcgccgtggggcgacggtgattatacgctgacggtgacagtggaggatcgggcgggaaatacgcgtccgtctacgccgctgacggtgacagtggatacgcaaatagccattgatcatattgaattagtcaacgatagcggcgtccctggcgataatgtgacaaaacatgtgcgtccgcagttccagatctcggtaccggatgatgtggaaaaggttcttctgagtattgacggcggcacgacctgggttactgcaatcaagagttcgacggttggcatttgggattacacctggccgacggatatgccagagggacagcataccctgatcgtggaagtgactgacggtgcgggtaataagatgacggggacgctcgatttcactatcgacatcacgttgttgacgccaaccattgagctagcgcccgatcaggataccggacagaataagaacgataatctgaccagcgtcactcagccggtatttgtgttggggagtatcgataaagatgttcgacacgtggaattgagtattgagcataacggcacgtttaaaacggtggtactcaccgaatcagccgacggctggcgctatcgaccggattctgctttggcggacggtagctacacattcaccgtgacggtaacagatgtggccggtaatcagcaaacatccgcgcctttaaaggtgacgatagacggtacgttgactacgccggtgattgagctggcggccggcgaagatagcggtactgttggcgatcgcctcaccaatcacgatcggcctgtgttcgacatacgccagattgattctgacgttacgcgcgtgatggtcaaagtaacttacaacggtaaaacgcacgaggaagcggcggtattcaccaatggttaatggcgctttacgccttctgcgagctgggctgatggctcatatcagttagccgttgtggtggaagatctggcggggaatgtaaaagaatctgcgccgttagaggtacgtattgataccacgacaaccattaacaatatcgtattgcttaatgatactggcgtgcagaatgatcaattaacgaatgttgccaaaccgtcattcagaattgacgttcccggtgatgtcgtccaggtacgcgtaaccctggatggtggcgctaactggaatgtgatacgcaaaaatgccgacggacagtggatttttgacagcccgaatactctggttgacggcacatatacccttcgcgtagaggccacggatgaggcaggtaatattgcaaataaagatttagtatttaatatcgatactaatatacaggttccgactattgctttagacgcaggacaagataccggagcgaatacagccgataatattactaatatttcacgacccacctttacgattggtaatgttgaccccgatgttatcaaagtcgtggtgacgattgatggtcatgattataacgcgactaaggttggggctggttggcaatttacaccaggcaatgccattccggatggttcttataatattaccgttacggttgaagataaggccggaaataccgcgacatcgaaaccattacctgttgtgatagatacgacggctgaaattgaaagcgtcacgttggttacagatagcggtgatagcgatgtagataacattaccaaagtcgacaagccgcagtttagtattgttaccgctgatgatattacccatgtgcgcgttaaaatcgataacgccgctaattggattgaactcacaaaaggaggggatggtcgctggatatttaatgtcggttcggcattacctgatgggcaacacactctcttggttgatgtgactgatatcgccggcaacgttgcgcaagaaacgctgcagtttacgattgatacgactctgcgagagccgacaattgtactcgatcccacccatgatactggtgatgatactaatgataatcttaccaggattaacaaaccggtgtttattatcggtaatgtcgataatgatgtatcacacattgtggttcatcttgatggtcgggattacaccattgaaaacaaaggggggaatttaacctttacgccggatcaaccgctgtctgacggtcagcatacgatctctgttaccgtaacggatattgctggtaataccaaaacatcggccgaactgcagattgaaatcgacacgcaggttcagattgacagtgttacgttaacaacagatagcggcgtcaacgatcacgataatgtcaccaatgctacccgtccctcttttgaaattgcaacgcctgatgatgtgacatcggtgctggtttctttcgatggcgtaaactggacgcccatcagtaaaaatgcggccgggcagtggcaatttactgcaggtagcgcattgtctgatggtcattatactctccatgtccaggcgacggatcgggcagggaatacggcaaattccacgctgggctttaccgtggatacgcagattgacggcctgagcgtcgtgatgctggacgacgccggaaaggattctacggatggtattacgaatattacctctccacgttttgaaatttcagccagagaacagttgcagagcgtgacggtaattttaaacgggaaatccagcaccctgactcagggggcaggtaataaatggctgtttacccctgatacaccgttagtggatggaacttacaaaatagaaatagtggctgaagatatcgcaggtaataaaattagcaaagaggtatcattcacaatagacactattgtttctgatcccagtattgatttgctggatgcggatgatactggcgaaagcgctgttgataatattacgagtgtcactacaccacgtttcgttattggcaatgtacccgccgatattgatactgttgtaatcagaattaacggcgtttcttatccggttacggcaaatggcaataacctctgggaatttcaggttcccgttgcgttaaacgatggcgtatatgaagtcgttgttgtcttcagagatattgccggaaatacttctgaaactaagctgccctttaccattgataccacgacaagcgtcagtgtcagaatggagccagcgtctgataccggcagctccaatagcgataaccttacgaataagcaaaatcccaaattcgaaggtactgcagagcccaatgcgaaactggtgattaccattgttgacgataagtcaggtcgggaggttttaaaacacacgattacggttggcgccgatggcaactggagtgtgacgccgaatatactgccggatggcatgtataccatcaacgtcgtcgcaacagatgtcgcgggaaatactgcgcaaacgcaggaaagattcactatcgatacggttacgatcgatcccaccattcgcctttcggatccatctattgatgatcagtatgaggcaaccagcctgcgtcctgagttcaaagggctcgccgaagcgttctcgacgattatgattcagtgggatgggaaagtggtcggctcggcaaacgccaatgcgaatggtgaatggagttggacgccgccatcagtattagcgccaggctcctatgttgtgagcattgttgccaaagataaagcgggtaatgaatcgtcgcaggtcgactttcctgtagtaatacctgttattgatgtcacgcctccaaccataaagctcagcgaggagagcgatagtggtgccttaggagactttacgacgaataataaaacgccgaccctgattgggagcacgttacctaatacaattgtgagtatttatgtggatggcgtgaaggtcggcgaggcgacagcggatacagcgggccgatatactttccagttatcggaaatgaaagatggccattatgtcgtccaggtgggtatcgtcaaccctcgcgataatagcgaactgcgttccaccgccgttgatgtcactatcgataccgaggttgctgaactggtatggaatatatctggaatgcatgagggcggatatatcaacacggtgacgccggagattggcggcaccagtgagccaaacagcaaaatcactatctttgtgaatggcgttgaaaaagcgattgcttatacgacaggcgcaggacactggggcgtagtattacccgctttgggtaatgacggtaattatgaattaacgtttaaagttgaagacgttgccggcaatatcagagagtttggtccgcagaatgtgatactggatacggtaatttcgccgttaaccgtggtattacgcgaagctgatgacagtggcaaagttggcgactggatcaccaataaatctcatgtcaccatcgatggtactgccgaagccggaagtactttgaccatcaggaatccgcagggagtggttattgctaccctggtggtaggcaatgatggtcgatggagcgcagaattagatctgcgtgaaggtagtaatgcctttgtcgtggtatcggaagataaagcgggcaacggccaacaaaaagatattctgatagaacatgatacgcagattgaaatcagcgatatttcattaagtcgggatactaatagcggtgataaatatgatctgattaccaataataagtctccggtactggttgccatgaccgatcccggcgcgacggtacaggtttatattaatggtgtgttacaaggcacagtagaggcgagttcgtcaggtaatattagctataccatgccggcaaatagcgccgacggcgagtatcaggtgcaatttgttgctacggatactgctggtaaccgggttgaatctgcgattacgaccgtgacaatcgattctcaaattgctgtctttgatattgatgaagattcattaccggccctctctaataaccgggcgttgtcagtctcaggcgtcggggaggctggttctcaggtcagcatctttgtcgatggtaaattagtcaacgttgttatggttgaggctgatggctcatggcgcgcgccgatactgctgcaagatgatggtacgtttaatattcatttcagcattactgacgttgctggcaacactcaagtaagcaagaattacagtgtggatgtcgattcatcaaccgacttcccaacgctcaaccttgaagatgcgagcaactctggttcacttgacgatctgattactaatcacaacaagcctgtgttagttggcaccgcagaagcgggagccacaatccatatttatgtggatgaaaagatcgtggcaaatgtgcttgtgcttgaagatggaacctggtcctatcagtttgataatgcgttaaaagatggtgaatattctatccgtgtggttgccgaagacccggcaggtaatacggcagaatcgcctcgcttactcgtcacgatagataccagtacgtttatcgataatcctgctatggtggcaggttctgataacggtattttcagtaatgatagtataacgagtcagacccggcctacgtttagtatttttggagaaatgaaccagagtgttcagattttcattgatggggtgttagtcgatacgatcacggtgacggacagaaatcaagtttatcgacctgagtcaccgttgggcgatggttcccatagcatttattatgttatcaccgataaagcaggcaacacggctacctcgaaaacgctaaactttactatcgatacctttaatacgacgcctgtcgccattgattctatcggtggacaaacgttagcagagatgaccggtagtgatggcaaaatatatataacggacacgacgcgtaacttattgtttagtggcagtgccgagcccaatagcaaaatagaaatcattattaatggcttaaatgtgggggaagtttgggttaatgaaaaaggccactggcagatgccggtgaacccgctttatttcacagaaggccaactggatatcactgttaaatctacggaccgtgctggtaacgtaaatcaggaaaagtattccatttgggtcgatacgcatatccaggtatttaccagcgagcttgatgacaataaatcatcatcgaaaacggactggtggagtaatagctccactattaccatgagaggtatgggggaaattggcgctacggtatcattaatcgtggcaggggtcacgctggcaaccgctgtcgttgcggctaatgggcagtgggaattatcgaccgatcagcttccggaagggaaatacgatatcactttgagtattgaggataacgcaggcaaccgtaaggaagaggtacatgaaatatttattgatcgaacgccgccaaacgctccggtcgtaacttattcagacattgtcaacgatctaattattatgcagggaacggcggaagccaaatctcagctaataataaccgatagtaatgggaatacttatacgttaaccgttcctgataatggtaaatggagtatggcgatcccgtatccatcggaagggaagtttaccattacgagtgtggatgcgattggtaaccggagtgatgatgtccctctcgatatcatgaaagaggttcccgttatttcattatctccagactcagacagtggtacggtgggcgataatattacgcgcgataagcaacctacctttattatcgggaatctggaaagcgatgttgtggtcgttcaggtcgatatcaatgggacagtatataatgctgaaaaaaatgccgatggcgtttggttctttacgccaggtacaccgttagctgatggttcctatacgatatcggtaatcgcaagcgatgccgcgggtaatcagaaaaactcgttacccattaccgttacgatcgacagtacgctgacggtgccggagattgcgttggcagcaggtgaagacaatggcgtttcagacagcgataacgtgacgaatcacacccagcctaagttcacgctgcagcatattgatgctgatgtgaccggggtgaccgtaaacgtgacgcataacggcgtgacagacacctatcaggcgacgcaaggcgcggatggctggaccttcacgccgccagccgcctggaatgatggtacctacacgctgagcgtgacggtggtggatcgcgcggggaactcacagcaatctgcttcgctagcggtgacggttgactcaacggtgacggtaacagcggatagccagcatgacgatgcgagcgatgacgccacgccaacagcggttactccaccggagtctgaaacagtgaatgccgaaagcgatacgcatcttcgtacagtgccgtctgcggcggaagaaagcgtggtgaaggagacggcctatagtattacattgttaaacgctaactctggggatgaaatagatcgttcaattagtcagacaccttcttttgaaatatcagtacctgagaatattgttaatgtcagtgttatgtttgaaggagaagagtttactctgccgataactaaccagaaagcaatattcgaagttccgctatctttggaagatggtgaatatactatggacgtgaaattcattgataaggacgatgatttcctgattaaggaaaaaacattctcagtcgatcactcctcggcggatattgtgaacgcaatgaatgcaagaggaaagaccgaggatgatattaatgattccccttccacgagttctgtagggcacaacaataacggcgctattgatgttttcgccgttaatgaagttacgctacctgtagataatcaagaagaacacgcataataacggaggcccctcacctttgggtgagggggtttacttatggataaaaaactagaaccttattatttaagtgcggaaacggcattatctatagtgtctaaaaaattcaacataaaaattgacatcaaagaggatgatataaatttaagatttaaaaagtacgacagaaataacactgatgactctatacaaatgaagaatttctttttgtcgttagggctttctctacaggatatattatttaataatggtgaggatttactaaatgagcctatgccgattttactattaacaccagaaatgaagtggatggtgtgtgtgagcggcgggcaaaaaataaagttggtaaacgcgcgcggtgaactctgttatgttgaaattgaagatgaatatttaaaagagttatctgcatttagtatactacctttaaataaagttgttgatagtataagagtaaaaaatatcataaaaaactctttatcgatgaacaagattttttatactaaatacttcttttcatctctttttatggcaatttttgcgttaactatcccagtatttagtaatctgttctatgataagcttgttccaagcgcttcggtttcatcgttatttggcgtggctataattgttgctgtatttattgtttttgagtttatccttcgtacttcgaaagatatttatcagtctatcacagcaaggcaggatgacgtcgatattgatatcgcatttcttgaagcggtactttatagtaaaaagaaaaatggcagatccatgtcatcagcatttgtgctatggaatgagtttcagaaaattaaacccgttttattaaactcgatctttcaacgtatagccgatattccaatatttattatatttctcattgttatatatgtaaatttaggtctggtcgttattgtacctgttaccatgtttatcgtctctattattattttcctcgttaaccaccattatactaatgagttaatgaacaaacaaaaagaaggacagaagaacaggaatatttttatctcagaagttttcttatctattaaaatgatccataccttaaataatcaaggtttactttttgattgggtcaacacatcaaatgaacagtcgtatcttaacctgaagataaggaaattaaatcttatctatcaatctatattggggagtatgtcatctattacccaaataactattatggtaatagccttttttatggtaatcaagggtgatgttactactggcgcaattgtttcatctgtcattgtctctggtcgtatttccgggatcatttcgaatttttcttctacattaatctctattttatcagcagaaaaaaccggtaaggatctgctttctttttttgatgaagatcaggcagaaaaaacaccggcattacagtcaatatcaaagtgcaatggcgatatctctattcggggcgtgagttatcagtatgatgctcaatctccgatgattattaatcgactgtctatagacatacctgcggggcagcgtgtcgcagtgataggcgaatgcggtgcaggaaaaagctcattactgggaatgctatctggctacctttcgccaacagacggtgccattttatatgatggatataacttaggacatttatcgcagaactttttttctcagcatttaagtgtggtgacgacacatgatgttttattcaccggaaccattgaaagtaatttcgcgttaaaaccgcaaaacgacaggggacgagtactcaaggcgcttcatctggcgaactgtggttttatcttgcaacatcctatggggctgaagtttccggtgaattttatggctaaaaacctgtcatccggacagcagcagcagttattattagcacgtagtctgagcagtaacgccagcgtctttttatgggatgaaccaacatcaaatctggatgagaataccgagaagcaaatttttgataacttagatgagtttattcatgggaaaacgttgatcatggtgacgcatcgtcgatacctgataaagtattttgaccgggtcctggtaatgaaaggtggaaaaataatccgtgattgttctccggataaattattaatgtaaaataagccgcgcttgtcgctgttatcaggtggtactgcttaataaaaaagacccgttgcacaaacgggtctttttttgtcatttaacgagtcggcaacgtcttcaataagtttagctcgattctgttagggctattccacttgccatttttggataaccacacctggcggccctcatcaacggcaatgcgagggacgtgatggttcgcaaggctacccctggcgcgcgattccgccttgagataaccggtgggcgacttcagcggcagcgatagcgtatcaggtcagcaccatcggccattctggcggggtctggctcatcgtttcgaccatcacggcttcaatgttatgccagatcgcagcgagatccatcatggtaataccgagtaaaccggtggcaaaccagcaggcggataccacgcccagaccgctactgatcaccgccagaccaatataatctgatttacggaaacggatattgagcgtgctggctaaaaacatgagcacggcgctcaacagttgccagcggagaagaacgacaccagtggttatggcagccatgaaacatttcctctgaatagacctttgtccaggacagcacggcgttgttcccgggaaacgtgggacattctggctatcaacggacgtcacatcaacatcgaatgaaacattgtttctgtttcattgtttttgtgaactatatcacaaaaacaggcttattcgccagatcggcaatgtattttttgtgcgttttataaccttattttttgtgtgacttctgcgcgtccgtagagaaactgccggaaagcaaagatgtattattactactcttttattttttttcgtgaaattcagacctgataaaaatatcaagttatttatcaaaagaaaggagtaaagatgtataccccatcgtttacttgagtataaatctgatattatcaaaaatatttagtgtcctgcctggtatgcgaaagagattgcgcgtagttattaatggtaaatgttgatcggtaaaagtctgttgctaatattgataaattcatgcaccgtaaacctccgtttggttcacgtcttattttgccaataatagtcacaaataatgcagggaaataggctgaaaatgagtcaaagcacacgacgcaaggtgttgagatttctcggaacgatcattgtggtattacttcctgtattgctggcgatctggtttgctcatatccgggcagtctctgaaaccagaaatcagttacattcatttgcgcagttggtattagataaaacggagcgggttatcctgcaagcagatttagcccgcgatgccgctgaacaatatcaggggcaagcctgtacgccagcccatcaacagcgaatgctgaatattatccgcggtcgtttgtacattaatgagttgatttatgctaagggccagcgttttctatgctctacggttatgacgccaacaagtccttattttattccccgcgctgactataaacgaaagcctgacatcgctatttattactatcgtgatacgccttttttcaacggttataaaatgacatatatgcagcggggaaactatgtcgcggttatcaatcccttatcttatagcgaggtgatgtcagacgatccggcgttggcctggggaatgtatgatacggtgaccaacacctttttctccctgagtgaacaggcgcaggctgatcagctattacctttggtacaacggagtgaacctgtgttccaacagggtgagcgtttctatgctctggttaaatcagcaaaacgaccggttgccgcgattgtttcaacctcaaagcaacgcttttaccagaacctctttcatcagcttacgttaacgctaccgttagggatcatctgtagcattatcgtcttatttatgtggtcacgatcccggcaggcatattactcaccgcgtcgattgctgcaacgggccattaccaggcaccagctttgccttcattatcagccgatcattgatatccgaaacgggacatgtgtaggtgccgaagcgctattgcgttggccgggttatcacggtccggtgatgagcccgtgcgaatttattcctctggcggaaaaagaggggatgattgagcagatcaccgattatgtcgtcgaagaggtatttaatgatttaggtggttttctggccgcgcactcgcatctttatgtctctatcaatctctctgccgccgattttctctcttcccgactaattgtgatgattcatgaaaaaacgcgtcagcattcagtgcttgcgcaacagataaaggttgaagtgaccgagcgcggatttattgatgtgccgaaaatgacgccgattattcaggcgtttcgccaggcgggatacgaggtagcaattgatgactttggtaccggctattcgaacttgcataacctgtactcattaaatgtcgaccttttaaaaattgataaatcttttgtcgatacgctaaccactaatagcgccagccatttgattgtggaacatattattgaaatggcgcaaagtttgcggctaaaaatcattgctgagggggttgaaacggctgaacaggttagctggttgctaaaacgcggcgtgcagtattgtcagggatggcactttgcgaaggcgttaccgccgcaggaattcatcgtctggctacaacaaacgcccgcgcctctgacgatacgcgggcagacgccctacaggcggtgacggtaatcgctgggagtgcgatcgaactcgcggcggaatacacgcgagaaggtttgctgcgatacatagcccaggtccatcgcgatatcaaaaatcgggcgctcggtcgttcgtagctcaacggccgctaacaggagacggcgctggcgaatatactcgcctaatgtttgatgcgttaccgtacgaaacatccgctgcaaataccacttggagtaacccgatttttttgccaccacatcaatgtttagcggttggttgatatgttcatcaatccattcgataagggtctgaattatctgctgatgcgacatattgttgcctcttaaacagtattcgattcgtcgttttgtctgcgggcgagtataattcctcaagttaacttgaggtaaagcgatttatggaaaaaaaatctccccgtttaaaagccttactgacgccgggggaagttgcgaaacgtagcggtgttgctgtgtccgccctgcacttctatgaaagcaaagggctaattaccagtatccgtaatagcggtaaccaacggcgatacaagcgtgacgtgttgcgttatgtcgcgattatcaagattgcccagcgtatcggcatcccgctggcaactatcggcgacgcgtttggtatcttgccggaagggcatacgttaagcgcgaaagagtggaagcagctctcctcgcagtggcgcgaagagttagaccgacgtattcatacgctggtggcgttgcgcgatgagctggacggttgtatcggctgcggctgtttatcgcgtagcgactgtccgctgcggaatccaggcgacaggcttggcgaacacgggacgggcgcccggctgcttgaagatgattaacatgcactcggccatcgggctgagctcacctaaaactaaagcgccgctaagggcgctttagtttgtttccggtctttgtctttcgctctatcccgctgattacaggagggtttcccccgacgtcaacacctctcatattgagcacgtggtggaggttccggtttgtgttgatactgtaagtgtaagcgacgacgccctgttcgccagcgaaatgctgattttttagccgaaatttttacggcaactgccataattttctatagttagttggcataccttacaggagacagccatgctgacggtgcaccatttaaatcagtctcgttcgcagcgcatcctctgggcgctggaagagctggcgttgccttaccagattgtgcgttaccagcgtgaaaagaccatgctggcgccgccggcattgaaaaaagtgcatccgctgggcaagtctccggttatcgaagatcacggtatggttattgcggaattgggcgccatcctggaatatttgcaggacacttacgacaatatcggacgctttaagcctgcggatgcgcagagaaaacaacactatcgattctggctacattacgctgaaggttcgctcatgcccttgctattgatgagactgctctttacctctctgggtaaaccgccggtaccattgggcctgcgaacgttgggcggcgtgatcggtaagggcgcgcaaaaagcgtacctcaatccgcaactggaaacccatgcgcgctttattgacgggcatctggcaaatcacccctggtttgccggagagcagttaagtatggcggatatccagatgagcttcccgctatttgcgctgcttgcccgaggcggaatcgctcatctcgaccatatcaacgcatggaaagcgcgggtagaaatgcgtccagcctggcagcgagcgattcagcagggcggtccgtttaccattcccggcggataatggcgtttttgtgagcagattgcgcaacgtatttgctaacagcgatgcgaaaaattgttgctggattgcgcagggacgataacgtttgcgcatcgtctggctatttattgagcatactaagcagaaaagcataaaaagcggcaaagttcagttgaaaaagcgttgatgatcgctggataatcgtttgcttttttttgccacccgttttgtatacgtggagctaaacgtttgcttttttgcggcgccccggctgtcgtaaatgtagcacaaggagataacgttgcgctgttagtggattacctcccacgtataccgacgaataataaattctcaggggatgttttctatgtctacgccttcagcgcgtaccggcggttcactcgacgcctggtttaaaatttcacaacgcgggagcaccgttcgccaggaagtcgttgctggcttaaccacgtttctcgcgatggtttactccgtcatcgtggtgccagggatgctgggtaaagccgggttcccgcctgccgccgtctttgtagcgacctgcctggtcgcaggcgtcggctctattgttatggggctatgggcgaatctgccgctggctatcggttgcgctatctcgttgacggcgtttaccgcgtttagcctggtcctggggcagcatattagcgtcccggtcgcgcttggcgccgtattcctgatgggcgtactgtttaccattatctccgctaccggcattcgtagctggattttgcgtaacttgccgcagggcgtggcccacggaaccggtatcggtattggcctgtttttgttgctgattgccgccaacggcgtcggcctggtcattaaaaacccgctggatggcctgccggtcgcgctgggcgatttcgataccttcccggtgattatgtcgcttgtgggtctggctgttattctcggtctggaaaagctgaaagtccccggcggcattctgttgaccattattggcatttctattgtgggtttgctcttcgatcctaacgtccatttttccggcattttcgccatgccttcgttgagcgatgaaaacggcaactcgctgatcggcagcctggatattatgggcgcgttaaaccctgtcgttctgccaagcgtgctggcgctggtgatgacggcggtgtttgatgcgaccggcacgattcgtgcggtcgcagggcaggctaatctgctggacagagacggacaaattatcgatggcggcaaagcgctaaccaccgactcactgagtagcgttttctccggcctggtcggggcggcgccagccgcggtgtatatcgagtctgcggccggtacggcggcgggtggtaaaacgggcctgacggcgattaccgtgggcgtgctgtttttgctgatcttgtttctttcgccgctctcttatctcgttcccgtctacgcaaccgccccggcgctcatgtatgtcggtctgctgatgctgagtaacgtggcgaaaatcgattttgctgatttcgtcgatgcgatggcggggctggtaacggctgtatttattgtactgacctgtaacatcgtcaccgggattatgatcggctttgccacgctggtcgtcgggcgtctggtttctggtgaatggcgtaagctgaatatcggaactgtcgtcattgcggtcgcgctggtcgctttttatgccggcggctgggctatctagttctgccttcattctgaaaaatgggcggcgttggtcgcccgttttcattttcaggacacatcacgttaccttttgcgttaatctgaagaaggtgaaaccgaggcatgatgcctttctccatcataaaaaacatcgcaaacagggaacgcatggaaattttcttcacaatactcatcatgacccttgtggtctcgctgtcgggggtatttacgcgtgtattacccttccagcttcctttaccccttatgcagatcgccattggcgcgctgttggcgtggccgacgtttggtttgcatgtggaattcgacccggaactcttcctggtgctgtttattccgccgctgctgtttgcggatggctggaaaacgccgacccgtgaatttcttgagcatggacgagagattttcgggctggcgctggcgctggtcctggtaacggttgtgggaatcggcttcctgatttattggctggtgtccggcattccgctgatccccgcatttgcgctggccgccgtgctgtcgccgaccgatgcggtagcgctctccggaattgtgggcgaggggcgtatcccgaaaaaaatcatgggcattctgcagggagaggcgttaatgaacgacgcctccggtctggtatcgctgaaattcgccgtcgcggtggcgatggggacgatggtctttaccgtcggcggcgcgacgctggaattttttaaggtcgctatcggcggtattctggcgggttttgtagtcagttggctgtatggccgctcgctgcgttttttgagccgctggggcggcgatgagcccgcgacgcaaatcgtcctgctgtttctgctgcccttcgcgtcttacctgattgccgaacatattggcgtctcaggcatcctggccgcggttgccgccgggatgaccatcacccgttctggcgtaatgcgccgcgcgccgctggcaatgcgtttgcgcgcgaacagtacctgggcgatgctggaatttgtctttaacggtatggtctttctgctgttgggactgcaattgccagggattctggaatcttcgctggcggcggcggaagctgacccgaatgtcgaaacctggatgctctttaccgatatcgtgctgatttatgcggcattgatgctggttcgcttcggctggctgtggaccatgaaaaagttcagcctgcgctttttgaagaagaaaccgatggagttcgccagctggacgtcgcgtgaaattctgattgcttccttcgctggcgttcgtggggcgatcaccctggctggtgtgctctctataccgttacttttgccggatggcagcggatttccggcgcgttatgaactggtattcctggcggctggcgtcattctgttctcgttgtttgtcggcgtgatcatgctgccgctgctgttgcaacatctggaagtcgtcgatcatgcgcaacagttgaaagaggagcgtatcgcccgcgcggcgacggcggaagtggcgattgttgccattcagaaaatggaagagcgtctggcggcggataccgaagaaaacatcgataatcagttgcttactgaagtaagctcgcgtgtcattggtaacttgcgtcgccgtgccgatgggcgaaacgatgtcgaaagctccatacaggaagaaaacctggagcgacgtttccgtctggcggcgctgcgttccgaacgcgccgagttgtatcatctgcgcgccacgcgagaaatcagcaatgaaacattgcaaaagctgctgcacgacctggatttgatggaagctctactgatagaaaatcagtagtccttgtggcccggtggcgccatgcttatcgggcctacaagtaggcccggtaaggtgcttgcgccgccatccggcaagggttttaacccatggcttacggttgtttcagccaaaacccttcgcaacaggttaaccatgcccgggcgctgtgcgacagatacacgccctcgcgccaaatcatgcccaactgccagcggagatcactttccagcggtagccagcgcagcgtggccttatccagacgctgacaaatcggctccggcaaaatggcgatgccgacgcccgcttgcaccatggcggcgagaaaatcccattgcccgctgcgcacggcaatccgtggttttacgtcatgctggctaaataagatcatcaactggcggctcagggcaaagtcttcgttatagataagaagaggatgctccgccagagcttcaggcgcgatggagtcgcaggttgtccactgaccggaacggggaaccagcacgcacagcggatggctgaacagcgataatgtcgtcagcccgctcgcttcttccaccgggagcgcggtcatcgcaacatccagctcgccattcattaccgcctgctgtaccgtcaggccgccaaactccgaaattttgagttcaacgccagggtagcgttgtcgaaacaaactgattggcccagccatcaacatgccgaccatcgggggaatacccagccgcagcacgcccttattgagatggttaatatcgctcaactcggcctctaactggcgaaactcagcgaggatcgccagaccgcgttcaaacaccacgcgtccggtatcggtcagcaataacttacgtccgtcgcggatcagtagcgtacagttaagctcatcttcaagatttttcagcatcttgctaatggtgggctgggtgacaaataacttctccgctgcgcgggtgaaactttgctggcgcaccacctcgacaaaataacgcagcgttctgatatccatgattattccttccgactatgcctgcaatgattttaattcatttctgcccgtgacggaggttctctatactggcgctccgtattatttttcaggacattccctcatggctgtggcgataagccgcgttacgcctgccgttgtgcaacgactccaggtaccggttcaggtactgctctatgcaggtttattcattttttcccaatattttgtctcctggctgcacctgccgttgcccgcgaatctggtcggcatggtacttatgttggcgctgatcgtttgccggattattccgcttagctgggtacgcgcaggcgcacgctggctgctggcggagatgctgttattctttgttcccgccgtcgtggcggtagtgaactatgcccatctgttactggtggacggctggcgcattttctcggtgatagcgatcagtaccttaatggtactcggcgcgacggcgtgggtggtggataaagtgtatcgctatgagatgagcaggctaaaccgtgaataacgttcagttaagcgtactgtgcctggtgattacgctgggaatttacttcgccaataagcgtctgtatcgccgttttcgcaaattgccgttgatgccattagtgttgacgccggcactgctggtgttaatgctggtgttcggtcatatctcctggcaaaactatattagcgaatcgcactggctattgtggctgctcggcccggcgaccattgcctttgcggtgccggtgtacgataacctcgcgattatcaaacgtcactggatgtcgctcaccgcgggtgtagtgacggcgacggtggtggcggtcaccagttccgtttggctggcgcgtctgttcacgttatcggatgagattcagcgtagtctggcggtacgttccgttactacgccgtttgcgctggcggcggcagaacccctgggcgggcagccggatctggtggcgctgttcgtggtcgtcactggcgtgtttggcatggcggtcggcgacgcgctatttttgcgtctctctatccgggaaggcatggcaaaaggggcaggattcggcgcggcgtcacatggggcaggcacggcgcgttcctatgaacttggtcagcaggagggcgtcgtcgccagtctggtaatgatgctgtccggcgtggtgatggtgctggcagccccgctggtggcgagggtgatgttctgattttcctccgacccacagggccggaggaaacggtaagattaatgcgcacgcccttgttgtacgccgaatcccgtttgggagcggataaactgagcgcggaactgctcacgttcacggttgccttctgccgagttatcggtggccgagaagaaccagatccccaggaacgccacgctgatagagaacagcgccggatactcatacgggaagatcgctttttcgtggccgaggatctgcacccaaatggtagggccaagaatcatcagcaccaccgctgtcagtaaacctaaccagccgcccagcatagcgccgcgcgtggtcagttttgaccagtacatggaaagcagaatgatggggaagttgcagctcgcggcgatagcaaatgccaggcccaccataaaggcgatgttctgattttcaaacaggacgccgaggataatggcgatcacgtccagcaccaggacggtgattttcgacaccttcagctcttcacgttcggttgcgcctttgcggaacacgttggcgtacaagtcatgcgacaccgccgatgcgcccgccagcgtcagacctgcgaccaccgccagaatggtggcaaacgccactgccgaaataaagccgaggaacaggttgccgcctaccgcgttggccagatgcaccgccgccatgttattgccgccaatcagcgcgcctgcggcatctttataggcgggattcgcccccaccagcatgatagcgccgaagccgataataaaggtcagaatgtagaaatagcccataaaaccggtggcgtagaacacgctcttgcgcgcttcgcgggcatcgctgaccgtaaagaaacgcatcagaatatgcggcaaaccggcggtgccgaatatcagtcccagacccaacgacaatgccgaaatcggatcttgcaccaatccttctgggctcataatcgccgtgcctttcgggtgtaccgccatggcttcggtaaacagattattgaagctaaagccgacgtgtttcatcaccataaaggccataaaactggcgccaaacagcaacaggacggctttgataatttgcacccacgttgtcgccagcatcccgccgaacagcacgtacatcatcatcagcacgccgaccagcactacggcgatgtgatagttgaggccgaacagcagttcaatcagtttaccggcgccgaccatttgggcgatgagataaagcgccaccactaccagggagccacaggccgaaagaatacggattggcccctgtttcaggcgataagaggcaacgtcagcaaaagtataacgtcccagattacgcaggcgctcggcaatcaaaaacaggataattggccagccgacaaggaagcccagcgaatagatcagcccgtcataaccggaggtaaacaccagcgcggaaatgccgagaaatgacgcggcggacatatagtcgccggcaatcgccagcccgttctggaacccggtgatattgccgccagccgtgtagtagtcgctacgggaacgtacgcgtttagaggcccagtaggtaataccgagcgtaaacacgacgaaaatcaaaaacatgataatcgcctgccagttggtgggctggcgttcaaccgcgccgctaatggcatccgccgcatgagcggcgaaggggagtgcggcggcgagcgccgtcagaactctcttcataatgctttcacctcatgcagtacggcgttattaagacgatcgaattcgccattcgcccgccagatataaattccggtcaacacaaaagaaatcacaatcaccccgacgccaatgggaattcctcgggtgacgctggttcccgcatgtagaggcgtgcccagccagccaggcgcgaaggcgatcagtaaaataaagctgatataaaccgccagcatgataaccgacagaatcgtggcaaaccgttgccgtttttcaactaattccctgaaacgcgcactgtcttctatccgctgataaatttggtcattcatcacagagctctccagaggtccccctgcgtctttcgcgctacaggcgcgctggccgcactcgcgcgccccagccacatagtgaactatgctgctgagggtgtgctcgcttgccgccttcctgtaacacgaaatcctttgggggagggtttttatatttccctctcccggtttgagagagggcaggggtagggtcgtaggccggataaaacgcgttcgcgttgccatccggcatttatggttatgacggcatcgcgatggcctgcttctcttcgagcagtttctccaccacgccaggatcggcgagagtcgaggtatcgcccagattgctggtatcgcccgccgcgattttgcgcaaaatgcggcgcataattttgccggaacgggtttttggcagtgagtcggtccagtgcagcacgtccggcgtcgccagtgggccaatctctttacgtacccagttgcgcacctccgcgtacagttctggcgacggctcctcgccgtggttgagcgtcacataagcgtaaatcgcctggcctttgatagcgtgtggaatacccaccaccgccgcttcggcgatcttcggatgcgccaccagcgctgactcgatttccgccgtacccagacggtggccggagacgtttaacacgtcatccacgcgaccggtgatccagtaatagccgtcctcatcgcgacgcgcgccgtcgccgctgaaatacatattcttaaaggtagagaaataggtctgctcaaaacgttcatgatcgccgaacagagtgcgcgcctggcccggccaggaatcggtgatgaccagattgccttccgtcgcgccttcttgcggatggccttcgttatccaccagcgcaggctgtacgccaaagaaaggacgggtggcggaaccggctttcagttcgatagcgcctggtagcggcgtgatcataaaaccgtctgtttcagtctgccaccaggtgtcgacgaccggacatttttccttgccgatcttcttccagtaccattcccacgcttcgggattgatcggctcgccgacggaacccagaatgcgtagtgaagaacggtcggtgccttcaatggctttatcgccttccgccatcagcgcgcggatggccgtcggggcggtatagagaatgttgacctggtgtttgtcgaccacctggcacatgcgagcgggcgttggccaattcggcacgccttcaaacattaaggtggtcgcgccgcaggccagcgggccatacaacagatagctgtgccccgtcacccaacccacatcggcggtacaccagtaaatatcgccagggtgataatcaaagacatacttaaaggtggtcgcggcgtagaccagatagccgccggtggtgtgcagcacgcctttcggcttgccggtggagccggaggtataaaggataaacagcggatcttcggcattcatcgcttcaggctggtgctcagggctggctttttcaatcaaatcgcgccaccacaggtcgcggccttcttgccagtcaatgtcgttgccggtgcgcttcaggacgatcacatgctcaacgctagtgacattcgggtttttcagcgcgtcatcgacattctttttcagcgggatactgcgtccggcacgtacaccttcgtcagcggtgatcaccagccgcgagctggagtcgataatgcgtccggcgatggcttccggcgagaagcccccgaagatcaccgaatgcaccgcaccgatgcgggcgcaggccaacattgccaccgccgcttccggcaccatcggcatataaatcgctaccacatcgccttttttaatgcccagatccagcagtgtattcgcgaaacggcagacatcgcgatgcagttcgcgataagagatatgtttactctgcgacgcgtcatcgccttcccagataatggcggtgcgatcgccattttcctgcaaatggcggtcaagacagttcgccgccagattcagcgtgccgtcctcgtaccatttaatcgacacattgcctggcgcaaaggaggtgtttttcactttttggtacggcgtgatccaatcgagaatttttccctgttcgccccaaaacgtatcggggtcgttaatagactgtttatatttagtctcatactgctctggatttatcaggcaacgatccgcaatgttggcgggaatggcgtgtttatgtgtttggctcatgctgttgttctccttgtaggatgttaataatatgtcgcataaacgttaaatgtagggtcttaataagttttgtttagtatttgggcgacagatcacgcaaaaagggagctgtgcaaataagcagcaatctattttttgattgtgtcccgtaaaattagataaattttcgggataacatgacgttatatgaaattttttaaaaaagtgatccgtgtccggaaatcagaaaagagagggagttttgtccaggttactaactctaaagtggtattttacatacacttacaattgattaaagacaacattttgagtgtggttatttgttacacatagaggagatcaatgtaataacagtatttgtgcggttgctgttatggaaaacgataaaaaatcgccattaaagataatggcgcaatctggatgagacctctatggcaaggaaaacactacgcgcacgccgtttcttcagccttatatttccttttttcttcattacctctgtttacgctgagcaaacgcctgtatccgcaaaaaccgttactgttgaagcgaaaaatgaaacgttcgcgcctcaacaccccgaccaatatcagtcatggaaagcgacgtcagaacagtctgcccgtgaagatgcgctggcggaagaccctcgtctggtgatcctgtgggcgggctatcccttctcccgtgattacaacaaaccacgcggccacgcgtatgcggtaaccgacgtgcgcgaaacgctgcgtaccggcgcgccaaaaacggcggaagacggcccgctgccgatggcctgctggagctgtaaaagccccgatgtcgcgcgccttatccaacaagaaggcgaagacggctacttccatggcaaatgggcgcgcggcggcccggaaattgtcaacgatttgggctgtgccgactgtcataacaccgcgtcggacgatttcgcccaggggaagccagcgataacgttgtcgcgcccctatgccgaacgggcgatggaggctatcggcaaaccgtttgataaagcgggacgatttgatcagcaatcgatggtctgcggccagtgccacgtggagtactacttcgacggtaagaacaaagccgttaagttcccgtgggatgagggcatgaaggtcgaaaatatggagcaatactacgacgccatcgccttctctgactggactaactcgctgtcgaaaaccccaatgctcaaagcgcagcacccggaatatgaaacctggagcgcgggcattcacggtaagaacaacgtgacctgtatcgactgccacatgccgaaagtacagaacgccgaaggcaagctctacaccgaccataaaatcggcaacccgttcgacaatttcgcgcaaacctgcgccaactgccacacccaggacaaagcgtccctgcaaaaagtggtcgccgagcgtaaacaggcgattcatgacctgaaaatcaaggttgaagatcagctggtacatgcgcacttcgaagcgaaagccgcatgggatgcgggggcgacagacgcggaaatgaaaccgattctgaacgatattcgccacgcgcagtggcgttgggatctggcgattgcgtcacacggtattcatatgcatgccccggaagaaggtctacggatgttaggcagtgcgatggataaagccgcggatgcccgaactaaactggcgcgactgctggcgaccaaaggcattacccatgaaattccgctgccggatatttcgacgaaagagaaggcgcagaaagcgattggtttgaatatgcaacaaatcaacgcggagaagcaggacttcctgaaaacggtcgtaccgcagtgggaagatcaggcgcgtaaaaacggtctgttaagccaataacctcacatgtgacaaatttgccggatgacagcgcaagcgctttatccggcctacagaagtcttgtaggccttaaagctgcgcgccatcaggcattatgtaatggagtgaatatgagcgtattacgttcgttattaactgctggggtgctggcatcaggcctgttctggagcctgagtggaattactgccacgccaacgccgcaggagtcggatcaacgctggacggtcacccagcagcgtaatccggatgctgcctgtctggactgtcacaagccggacaccgaaggtatgcacggtaaacatacgggcgctatcaacccgaacaataaattgccgataacctgtaccaactgccacggtcaaccgtcgcttcaccaccgtgaaggggtgaaagatgtgatgcgttttaacgacccgatgtatacggtagagcagcagaacagcgtctgtatgtcctgccacttgcctgaacaactgcaaaaagcgttctggccgcacgatgttcatgttactaaagtgacctgcgccagttgccattccctgcatccgcagcaagacacgatgcagacgctaaacgagaaagggcggatcaaaatatgcgtggattgccacagcgatcagcgtactaacccgcactttaacccggcgtccgttccgttgcttaaggagcagccatgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgaccggcgcatcatttcgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaactaacctgaaagcgggcaaacagcccgcctgcgttgagtcatgtctaacgaaggcgctgacgtttggtaatctggacgatcccaacagcgatatctcccgtttgttgcggcagaaaaccacctatcgttacaagctggcgctgggcacaaaaccgaaggtctaccgcgttccctttaactatggggaggtgagccaatgacatccgcttctgcatttcattttgcatcactggtgtgggactggcccatcgccatctatctgttcctgattggcatctccgccggactggttacgttggcgattctgctacgccgcttccatccggaggcgggcggttcggacagcacgctgctgcgcactacgctggtgttagggccgggggcgattattcttggtctgctgattctggtcttccacctgacgcgcccgtggaccttctggaagctgatgtttcactacagctttacctcggtgatgtcgatgggggtgatgctgttccagctttacatggtggtcctgatactgtggctggcgaaaatctttgaaaaagaggtgattgccctgcagcaacgttggctgccgcggttagagatcgtgcagaaagtgttgacgctgatcgcgccgttccaccgtgcgctggagacgttaatgctggtgctggcggttctgctcggcgcgtacaccggctttctgctgtcggcgctgaaatcctatccgttcctgaataacccgatcctgccggtactattcctgttctccgggatttcctccggcgcggcggtggcgctgatcgccatggcgttacgccatcgtagcaacccgcacagcacggaagcgcgctttgtgcatcgcatggaggttccggtggtatggctggaaattttcctgctggcggcgttcttcgtcggtctggcgctgggcgatgacggcaaaatgcgggcgctggcggcggcgctgggcggcggattctggagctgatggttctggcttggcgtcgtagggctgggattgattatcccgatgctgctaaaaccctgggccaaccgcagcgtcacgtttcacggcgtgctggccgtttgcggcgccagtttgaccggcgtgctgctgctgcgctttttcattctttatgcgggacagctaacggttgcataatctggacatcttccttcctgaagccggatttctggcgctgttgttgagtctcggggtcaacgtgttaaccccgctggcgacgtggtgcgggatggcgcagcattggcgtggcgtcatgcgcctgacgacctgcggcgcgtggacggcgttcacgctgctgctactggcgtttgcgattctgtttagctgttttctgaccagcgatttttcggtcgtttatgttgcgcagcatagccatagtcagttgtcatggggactgaaactggcggcggtatggggcggtcatgaaggctcgctcctgctgtgggcgctgcttctttcggggtggacggtgctattcgcctggcgctcccggcatgaatctgacgcgctttttccgctgaccctgagcatcttgtccctcattatggcttcgctgctgctatttattgtgctgtggtccgatccgttcctgcgtattttccctcccgccatggaagggcgcgaccttaatcccatgctgcaacatctggggctgatcttacatccgccgctgctctatctgggttatggcggcctgatgaccgcggcgagcgtagcgctggcctcgctactgtgcggcggctttaacgcggcaaccgcctgggtgtgctggcgctgggcgttactcggctggtgcgctctgacgctggggatcattctcggatcgtggtgggcgtattgcgaactgggctggggcggctggtggttctgggacccggtggaaaatgcctcattgttgccgtggcttgccgccagcgcgttgctgcacagtctgtatgtcagccgccagcgcgggagcttccgccactggtcgttgctgctggcgatactgacgctgatcctctcgttgctgggaacgctgattgtgcgttccggcattctgctctccgtccatgcttttgcgttagataatgtgcgcgcggtgccgctgtttatcctttttgccgcgttaagtctggcatcgcttgctctgtacggctggcgggcacgggagccgtatccggcgacgcgtttgggcggcggaaagtgcgaaacgctcattctggcgacgctgctgctctttagcgccgtcttgttgatcgtgctggtcgggacgctctaccccatgatttatggtttgatgggctggggaaggctttcggtgggcgcgccctattttaatcgcgtcacgctgccgtttggcctgctgatgctggtggttatcgtgcttgcgacaatcagaagccgcaaagtctctgtgcatcgtcagcttccggcgttgctggcgcatacgggcgtatttatcttcgccgccgggatcatggtttccagcggcagtcggcatgaaatcagccttaacctcagcccggagcagcaggtggtactggcgggctatacctttcgtttcgagcgtctggatctggaagccaaaggcaactacaccagtgaaaaagcgcggatcacgttgtggcggaatgaaaaacgcattggcagcctgcagcctgaaaggcgcttctatgccgcgcgtcgtcaacagatgatggagccggggattcactggaacctgctacatgactggtacgcggtgatgggcgaaaaaaccggagcggaccgttacgccatgcgcttatacgtgcagaccggcgtgcgctggatctggggagggggattgttgatggtgtgtggcgcgctgctgagcggatggcgggggaggaagcgtgatgcgtaaattactcacagcgttgccggatggcggcgtaagcgccttatccggcctacaggatgcgcaaaccgtaggccggattagcgtagcgccatccggcagaaagtttttactcttaacgatcgtcctgtttttaatcacattcgccacccacgcccaggtggtggatacctggcgctttgacaatccacaacagcaggaaaaagcgctgtctattgccggtcaactgcgctgtccgcagtgtcagaaccagaatttgctggaatccaatgcgcccgtggcggtcagtatgcgccatcaggtttacagcatggtggccgaaggtaaaagcgaagcggaaatcaccgcctggatgaccgaccgttatggtgatttcgtgcgctacaacccgccgttgaatgagcaaacgctgctgttgtgggcgctgccgtgcctgctgttattgttggtgggcgtggtggtctggcgggtgagaaagcgtcagcacgcagaagagggggaacaatgagccagtctgagcactccactgtgccgttacgtcccatgcccgtaaagcgtctgacggctgcggcggtgttgatggtggctgtctgtatcggcggctatatgttgacgccgaaatggcaggctgtgcgtagcgagcaacagcgtctggccgatccgctacgtgactttacgaacccgcaaacgccagaggcgcagctttccaggctgcaagaaaaaatccgcgccaatccgcaggatagcgagcaatgggcgcggctgggcgagtattatctctatcgcaatgcgtatgacaatgcgctgctggcatatcgtcaggcgttgcgtctgcgaggcgataacgcgcagcttttcgccgcgctggcaacggtgctgtattaccagtccgggcaacatatgacgcctgcgacgcgtgaaatgattaataaagcgttagcgctggatgcgacagaagtgaccgcgcagatgctgctggcggcggatgcgtttatgcaggcggattatgcgcaagccgtgtcgctgtggcaaaccttactggatgcaaactcgccgcgagtgaaccgcgcgcagctggtagaggccattaatttggctaaattgttacaaaatcggcagaaataattttttcttttttgtgacttttgtcatgtgtgctgtttaaaaaaacggcgaatgcgccacaggtaaaaattaattacctcagaatattattcgattttgacgaagtaaaaaactttccataacaaatagttattcatcattaacaccataaactcgcgttattatgcataaaaacagccaaaagccctgttatgaaaggattgcgcaagacgctatgcaaatgatactgattatgcgcgttaaaaaactctacaaaccaacgcaacacaaatcatacccttccagtatgtattgctctcatgctttcggcggagagcaacgcttcatcgaggaagtctgttgttatgaaaaatttgaaagtcagcctggcctggcaaattttgctggctatggtgctgggcattctgctgggcagctatctgcattatcacagtgacagccgtgaatggctgattgccaatctgctgtcgcctgctggcgatatctttatccatctgattaaaatgatcgtcgtgccaatcgtgatctcgactctgattgtcggcatcgccggcgttggcgatgcaaaacagctaggccgtatcggcgccaaaaccattctctattttgaactgatcaccacggtggcgattatcctcggcattacgctggcgaatgtctttcagccaggctcaggcattgatatgtcgcaactggcgaccgtcgatatttcgaaataccagaacaccacggcggaagtacaaagtcatgcacatgggctgatggggacgatactgtcgctggtgccgaccaatatcatcgcatcgatggccaaaggggatatgctgccaattatctttttctcggtcctgtttgggctggggttgtcatccctgccggcaacgcaccgcgaaccgctggtgacggtatttcgttccatctctgaaaccatgtttaaagtcacccatatggtgatgcgctatgcgccagtgggcgtttttgtgctgatcgccgtcacggtagcgaattttggtttcgcgtcgctgtggccgctggcgaaactggtgctgctggtacactttgccattatcttctttgcgctggtggtgctgggcatcgtggcgcgcctgtgcgggttaagtatctggattctgattcgcattctgaaagatgaattgattctgacgtactcgaccgccagctccgagagcgtgctaccgcgcattatcgagaagatggaagcttacggcgcgccagcctctatcaccagtttcgtggtgccgaccggttactcatttaacctcgacggctccacgttataccagagcatcgccgccatttttatcgcgcagctatacggtatcgacctgtcgctgtggcaggaaattgtactggtgctgacgctgatggtgacgtcgaaagggattgccggcgtgcctggcgtttccttcgtggtgttactggcgacgctgggcagcgtgggcattccgctggaagggctggcgtttatcgccggtgtcgaccgtatcctcgacatggcgcgtactgcgctaaatgtggtggggaatgcgctggcggtgctggttatcgccaagtgggaacacaagtttgaccgtaaaaaagcgctggcctatgagcgcgacgtactgggcaaatttgataagaccgcccaataacggattgccggatggcgctttgcttatccggcctacagagaaagagaatgtaggccggataaggcgttcacgccgccatccgacaaccggctccgggttgcctgatggcgctacgcttatcaggcctacaacgactacgttcatcaggcaataaacatcagccatttgttagcgtttcgaactcttcgcaaccggtatcaaacccttccagacagcttagattcaaccaatgcaacgccttctgcttgttcttttcaataaagcccggttcaccgtttaaaaacatcattcccgcccagtattctgaatagccggtacgggaaatagcggaactgcgtttgaaataccaggcggctttttcatcatcggcggcaatgcccacgccgttggcgtaaatcaggccaagcaacatttgcgcatccaccgcggagtcgttatccagatcttcagaggccttttgcagcagcgagatggcttttgggtagtccggacgcccggcctgggtgttgaccaggatccgcgccagcgtaatttctcccgctttactgcccgcgttagccgccttttcagccagctttttcgcgtcgggataatccaggcttaccggattagtgattttgatttgcgccagtagcgcgcaggcgtcggcgtcgccattgtcggcggctttttgcgcccagtattcagctttgttcaaatcgccatagctcaaccaactgtcggccagaaaatattgcgcgcgtctgtcacctgcctctgctgcctgcaaatactggctacccggctcaggatctgcggcatgggcaaagaatgtcataaacaacatcaatgcaataagtggtttcattttgaattttatttagggtacggaaaagacagtataaagagatcgtatggataaaaaaacagcctccgggcggaggctgttatagggaaaatgcctgatggcgatgctaatgcatattatcaggcctacagtagacgcaggccgaataaagcattctgatgccgccatccggcagatcaacccattgcgctttcgcgcaggcgggttttcagcttgttgtactcatcaatcacatactgctcggcggctcgctgatcggcgatcggctcaacgcgtacggcgcagtatttgtactccggcgttttggtaatcgggctgaggttttcagtcaccagctcgttacaggcgccaatccaccactggtaggtcatgtaaatcgcccctttgttcgggcgatcgctgacctgcgcgcgggtgatgattttgcctttacgcgaatgaacccacaccagcgcttcatcttcaatgcccagacgcgcggcgtcggcggtattgatttgcgcatagcccggttcatcggccagcgcggccagcgccgcacagttaccggtcattgagcggcaggagtagtggccgacttcgcgcaccgtcgacagtaccatcgggtactcttcggtgagtttatcgataggcgctacccagtcgcaggtgaagaactgcgccagaccgttgggggtatcgaacttctctttaaagaggtacgaggttccctgatcggcatccgacgtgtcgcggcatggccactggatatagcccagttcgcccattttctcgtaagtggcgccgtagaaatccgggcacagatgacgcaactcatcccagatctcctgggtgttgttgtagtgcatcggatagcccatccgggtggcgatttcactgataatctgccagtcggttttcaggtcccacttcggctcaacggctttaaagaagcgctggaagccacggtcagccgcagagaagacgccttcatgctcgccccaggaggtggagggtaaaatcacatccgccgccgacgcggttttggtcatgaagatgccctgcacgatgaccagttccaggtcctcaaacgctttacgtaccgcagagagctccgcatcggtttgcagcggatcttcacccataatgtacgccgcgcgcacttcgccatgcgccgcacggtgcggcagctcgctgatgcgatagccggtatgtgcaggcagactttctacgccccaggctttagcgaacttctcgcggttttccgggaatttaacgtactggtagcccggataagtatccggcagcgcgcccatatcgcacgcgccctgaacgttgttctggccgcgaaccgggttaacgcccgcgcttggcttgccgaggttaccggtcagcatcgcgaggctggtcagtgaacgcacggtttccacaccctgatagaactgggtgacgcccataccccacaagatcgccgcgcttttcgcgctggcatacatccgcgccgcctgacgaatctcctgtgcgctcacgccagtgatctcttcaacggactccggcgtatagccttcgacaatcttactgtactcttcaaaaccttcggtacggctggcgacaaacgctttgtcgtacaggttttcttcaataatgacatgtcccatggcgttgagcagcgcgatattcgagccgtttttcaacgcgatatgcatgtcagcgatgcgcgcagtttcaattttgcgcggatcgcagacgataattttcgccccgttgcgtttagcgttaatcacatgattcgccacgatagggtgggaatccgccgggttatacccgaagacgaacactaaatcagtgttatcaatttcgttaatcgcattactcattgcgccgttaccgaccgattggtgcagacctgcaaccgatgggccgtgtcagacgcgagcgcagcagtcaacgttattggtaccaataacggcgcgtgcgaatttttgcattacatagttggtttcatttccggtaccgcgagaggagccggttgtctggattgcatccggaccgtacttcgctttgatggcgctcaaacgttcagcgacgtaattgagcgcttcatcccaggaaacagattccagtttgccgccacgctggcgacggatcattggggttttcagacgcggggtcaggatctgggtatcattaataaaatcccagccatagtagcccttcagacacagggtaccctggttggttttcccctgcgccgcctcagcccggacgattttgccgttatcgaccaccagattgattttgcaacctgatgcgcaatacgggcaaaccgtgacgactttttttatcggtttcgctccagttaatcaaatcgcgcatacgcgctgtcgccctcagtatgcatgttttatgccacttttttagtatgggctttccctgatattacgggcgaattttgctcaaaaccctgacgaaaaacaggctatcgtcagttttgacgtgtcgaaagaaaatgccgcatgacatttattatggggagaaacgcggagcgcaggccagataaggcggaacgctctgcctgaagtggatattatccggatggatagactcaaggtcagggaacgctttgagactaacgccaggatagaacaggccgcggcaggcagtttcataccgtggcccggcttcagaggaggctgaaaaggattatcgcggcaaaaatagcggcaataacgagatatttcagcgcgtaatagagagtacggtttttctttttcagccgttgcccggcatcgcgtgctgcgtgaacgtatttaaagatgcgattaatcgcaccggtgcgatcgttctcgtcgtttggcgaactggcggcggacatcaacgatgcgccgacccagtggtttacgctctgcgcccagcgccatttcattgggcgctcaatatcgcaaaagaggataatacgcgtctgctcagttttattttccgcccaatgaacgtaggtttcgtcgaagatgacggcttcgccgtcgcgccagctatggcgctgtcgatcaacttcaataaaacagcggtcatcattcggtgtgcttaatccaagatggtaacgtactgaaccggcataggggtcgcgatgttttcccagataggccccgggaggcaactcggcgaacatcgccgctttgatagaggggatgctgttgaccagctttgtcgttatcgggcataacgtttctgccgacgggtgggcatcggaataccatttaagataaaaccgtttccagccgcgcttgaaaaaggtgttgaatccggcgtcgttattggcctgcgcggcttttatgtgatgctgaagccgtagcgcctcttcacgaatcacctgccagttttccgtcagcttctgcagctctggaaatgccgtggtatcaaagtacggctgctttgccggtaacgttgagaagcgagtcatgaacatattgatcggcgccataaacgtcgagtggtcaaagagctgacgggaaagtttttgtttttccaccccgcgtgaatgcgcataaatgacgctgataataaaaataccgataatgattgctgcgaacataacgtcactgtccttctaagaaaacctcatcccgggattttcaggcaaccctcccggtgatgccaaagagaaaagtgtagttcgttgacaataaatttacatttctacaacttaaaagggccatttttgttaaagaagcgagtcagcccgtttaacctttatccaggcttgtcgacagtagaattgagatgactccgctacttcacccggtgacggctgattacgttatgccttatctcctgatgacggttgccagatcacaatgctttcgtaaaccggaaatgactttgcttgtaaccttcgcgaagataaaaacggtgtgcatcgcggcgtttaatatttgtggaaagctccgttagctccgcacccgcctgacgtgcttcttcttctgcccaggccagaagctgactgccaactttttgtccccgcatctgcggtaataccaccagctcctgaatttcgccaatccagttggcatgatggagatgaaactgcatatgcaggctgatcatgccgaccacctctccgttgcgtagcgctaaacgataatgaaggttggggtccagtaaattagcggcgaacccatccctgaaagcctgataatcaagctcatttttaagtaactcacagataagcgcgtaaacagaatcggtatcctctgttgtcgcgtggcgtaattcacagactggcataatgtcctcccgacgcttcatcaggatcaaccatctttcgccagactgtagcaaactaccgtcattatttattctatggcagctaaacggcggataacgtgcagccaaagatcactctgatggcaagggggaaggcgagcctcccggggagttaggtggcaggctgatgtttaaccacgttaatcatccacggcacaccgaaacgatcgctgaccttgccgaaaccctgcgcccagaaagtctcctgccagtccatttcgatttgcccttgtgcggcaaggttatcaaaccagcgcttcccttctgctacatcctgggtatcaagcaccagcgtaaagccggaataatgcgccgttcccgacgcgctggcatcactcatcatgatatcgctgcccgcaatgcgcatgttggcgtgggcgatagcagtatcgggaaagcgcattcctgacgggcagccctcttcattatccgccgccgaggggggcatttcaccgaagctgagtttataaagcagttctgcgcctaacgtttgttgataatacgcgatggcgtcggcacagttgccggcaaaagagagatagggacttaacggcatgatggttacctcaggtaagagatgctcgttaagtgtagttcgaaattggcacaatattgtcggtggcagggccgctcaggcccggtaagcaaggcgctaccgggcaatgatacggtaaatcagttctttttcacgaactcggatttcagtttcatcgggccaaaaccatcgattttgcagtcgatgttatggtcgccttcaaccagacgaatgttcttcactttggtgccgattttcagcatggaagagctgccttttactttcagatctttcacgatggtgacgttatcgccgtccgccagcaggttgccgttggcgtctttgacaatcagctcatcgctctcctgagcgggttccgcatcgttccattcgtgagcgcattccgggcagatgaacatgccgttatcttcgtaggtatattcggagttacattgcgggcagtggggtaatgacatgttggtatcctcaaaaagtcagcgggggcaaacgcgcccaaaaatggcagatcgccgaaaaaggccgcaattatacacaaaatccttagtgttgtcgggactattgccgcttttataaaaggggctgcgccacgccagtcagcaatggtttacactcgaataaccgcttttttactgccactacagcgcattagggcgtccttgtttacaccttttgaccaaattgacatatatgtgtgaagttgatcacatatttaaaccctgttagggtaaaaaggtcattaactgcccattcaggcgtcaacaggttcggttgtacagtccgtaaccggacagtgtaagtaaacctgctacgcttgtatgagggatagcgttcgcgcccctccctccgctcgacggcgacgctggcgcggtatgccagtgcccgccgtatatagcgctacagggcttagcctatgaggacagctatgctgaaaaggaaaaaaataaaaccgattacactgggcgatgtgaccatcattgatgatggtaaacttcgcaaagcgattaccgccgcgtcgctgggcaacgcgatggagtggtttgattttggtgtttatggatttgttgcctacgcgttgggtaaagtctttttccccggcgccgatcccagcgtccagatgattgccgcgctggccacgttttccgttcccttcctgattcgtccgctcggcgggttattctttggtatgctcggcgataaatacgggcgccagaagatcctggcgatcacgattgtgattatgtcgatcagtaccttctgtatcgggttaatcccctcttacgcgacgatcggtatctgggcgccaatactgttgttgctgtgtaaaatggcgcaggacttctcggttggcggggaatataccggcgcgtcgatctttgtcgcggaatattcgccggatcgtaaacgcggatttatgggaagctggctggattttggttccatcgccgggttcgtgctgggcgcgggcgtggtggtcttaatctcgacgattgtcggcgaggagaatttccttgagtggggctggcgtattccgttctttatcgccctgccattggggattattggtctctacttacgccatgcgctggaggagacgccagcgtttcagcagcacgtggataaactggagcagggcgaccgcgaagggttgcaggatgggccgaaagtctcctttaaagagattgccaccaaacactggcgtagcctgttgtcatgtatcggtctggtgattgccaccaacgtgacctactacatgctgctcacctacatgccgagctacctgtcgcataacctgcactattctgaagatcacggcgtgttgattatcatcgccattatgatcgggatgctgtttgtgcagccggtgatggggctgctgagcgaccgtttcggtcgacgtccatttgtgattatgggcagcattgcgctgttcgcgctggcgatcccggccttcatcctgattaacagtaacgttattggcctgatttttgccggtttgttgatgctggcggtgattctgaactgctttaccggggtgatggcctcgacattgccggcgatgtttccgacgcatattcgttacagcgcgctggcggcggcttttaatatctctgtattgattgccggtctgacgccaacgctggcggcctggctggtggaaagctcgcaggatctgatgataccggcgtattatttgatggtcatcgcggtgataggcttgattaccggtatttccatgaaagagacggccaatcgtccgttaaaaggcgcaacgccagcggcgtcggacatccaggaagcgaaggaaattctgggcgagcattacgataatattgagcagaaaatcgacgacatcgatcaggaaattgcggagctgcaggtcaaacgttcgcgtctggtacagcaacatccgcgtatcgatgaataaatttcgcgcttaaggttcgcttaatctctcgcgggcatactctcctccatacctttggaggagagcgtcatgaaaagctatatttataaaagtttgacgaccctgtgtagtgtgctgattgtcagcagttttatctatgtgtgggtcacgacgtattaaacgcctgttatgcctttttcaacagcacccaggcacgggtgcctgttctttccgtacggttttgcaggaaaaactgtccctgatgtagctgggtgatgcggctgacgatactcagccccaggccaattccgccataacggctgtccatccgcacgaacgcttcgcttagcttcccgcatttgctttcatcaatacccggcccctcgtcttcgaccgccataatagcgtcggggtcggcgctaatgtggatagtgatatgggttccttcagggctatagcgatgcgcgttttccaccagatttcgcagcagcatacgcagtaacgtcgcgtcaccgcgcaccaccacgtccgccgcgctttccggcagcaacagagtttgctggcgcgtttccagcatggtgttcagctcatcgtaggaggggaggatcacatcttccagcagttttacttcctgataattcccggaagagaatgactggcccacgcgcgccagttgcagaagctgggagacgctatccatcatctggtcaagacgggcgataagcggcacgacatcaacattgtgggtttttgacaataattccagatgcaaacgcacccccgacagcggcgtgcgtagctcatgggccacatcggcggtaaaaaggcgttcattgtcgagcgtggtggtcaaacgcgtaaccagttgattgatcgccgagacgacggactcaatctcaagcgtggagctgtgaatggcgatcggcgtcagattatccgccgtccgcgcttccagctctttttgcagttcggcgagtgggcgggtaatacgccgtaccgcctggtagcaaaccagcagcgtcaggctaaccataaatacgctggggacgatcaggctggcgaccgcctcgcgaatttcgtgcatgatatggcgatcgttgttgcgattatcccgcagcgcctgctcgaacagttggatttgctcagtgctttcatgccataaccagaaggtactgattagctggaacaccagcagaataagaccaattgtcagcgttaaacgctggcgaagggtcatcgctcttcgctgaaaacgcatcaggctcacttagctttcctcagtggcaaccagcatgtagccaaacctgcgaaccgtgcgaatgcgcgacttgccgactttgtcgcgcaaattatgtatatgcacttccagagtgttggtcgagggttcgttatcccagttgtagatatcgttataaagaatttcccggtgcaccggactgcctgccttgagcatcaatcgtgagagcagcgcgtactccttaggcgtcagggtcagttcctgtccatccctccatgcctgatggcggcctatattgagcgtcagattgccaaccgtcagttcactttcaccctggttattatggcggcgcagcaacgcgcggatgcgggcgtgcagctcctccagggcgaagggttttaccagataatcatctgcgccgacatccagcccgctaatgcggtcgttgagcgtatcgcgggcggtcagaatgagtaccggcagggtgtattttttctgtcggattcgcgtcaggaaatgcaggccatcctcatcgggcagccctaaatccagcaccatcagactgtaatgaccagactccagactatgctcggcggcacgcgctgtcgaaacgccatcacacgcatagccttcggtttgcgcggcgagtattaacccctgtaataatagcgtgtcgtcttcaacaatcagtatcttcattcgcttagtctcctgcacggttgcagaatatcatctgcggcctggtaatacgtcgtttgtacgccggttaatcccagcatggttgagaaaagattgtcctgtgaataatccagcgtgctcgcccgtttttgcaggcaggcctgatccacctgataacgctgttgataatctttagaaagccaaatgagcatcgggacatgtttttgcgtatccggcgcaatggaatacggcaaaccgtgtaaataaacgccattttcacccaatgattcgccgtgatcggaaagatagaccaggctggtggtgaatttatcctggtgagatttcagcaggttaatggctttatctacaatatagtccacgtacagcacggtattatcataggtgttgatcaactgctgttgggaacagttctgaatttcgttagtgtcacaggttggggtaaattttttaaactgcggtggataacggttgtaataggttgggccgtggctgccgatggtatgcagtacaataacgccatcgcctttcaaatggtcgatatagtcttccagaccgtgaaataacacttcatcgtagcactcgccgtcgatacattgtccgggcaggtttagctcggtgacattttgatgcggaacgcgatcgcatgcgcctttacagccgccgtcattatcattccacagtacgttaatccccgcgcgctggataatatccagtagcccttcctggtgatgcgccagctcttcgtcataatgtttgcgcggcatatcagaaaacatgcagggaacggagatcgcggtcgccgtaccgcaagaggtggtatgcgggaagtagatcacatcgtctttcgccagccgcggattggtgtcgcgcggatagccgccaagagagaaatcatcgccgcgcgaggtttcgccaacgatgagaatcgtcaggtttttgcgatcgcctttcagcattaatggattgcgatgggcatcctcgccaatgcgtaccagcggcaaattcgccagccgttgatgcgaataccatgaccaactggcgacaatactgttcgatgggcttaacgctttgatcaactgtttattatttcgaaatagcgaggcgtaatctttatagaaaaaggcggcgaccagaataactaataaaatagagatcaggacgctggccaggcggtaaagcccgctccgtaagcgcggcgtcgccggacggattttgacccagaaggcaatcacggctgccagaacgccgcttaatcccagcgtcagcaccatttgcggcgtcatcagagcaaaagtttccgcgggcgtggtatccatcatattggcgatcatggagcgatcgatgatgatgccgtaagtcaaaataaaatactgcgcggcagcgccgaccagaataaaaatgcaggccagcagtcggtttagccaaataaatgaggccagcgtcagcacactattgaccacgctaaacgcgacgaccggcatggaaataaacaccagcacattgcgcagcgagtttaacggtaggtcttgtagtacctgcttgtagaacgcaatgttcaggcagacggcaatataaaaggaaaaaagcagaagccaggcgatttgcccaagaacaggtcttttaagaaagcgctttaacatgttgatgcgtccatcgattcggtgacgctaatcgtgacaaagtaaaattaagtgaaccttaagaacttaatgttggtggtggccggataacctgcgctatccggcctgttgcgataacattaactacacgtggtcaatcttgtttaaccggcgcatccagcggatacgggtttttgtgaatgcggttgtagttcaacgcatacagcgcggtgatcaccatcaacgtgacgaacgaccacatcacttctttggcgccggaaccgataaccgcccagatgcaatatacaaacgcgacgaaggtaatcagcagatacagcgggcgcgctttaccaaagtgaccgtggcccaatagcaacagcgcggcacaggtgtaaagataaggcaccagggtgaagataaccgacacggaggagaccagaccaaactctttcgcggcgttcggcgacatactgctgaactggaagatagtcatcagcacgccgacgataagcaacccagccactggcgtaccggctttattaacccgcgcgaagatcggcgggaagagaccatcgtccgccgccgcttttgcggtttggccggcaagcagcgtccagccgccgagagagcccaggcaccccgctgccgcacagaaggaaacaatagcccctgcggtatcgcccagcgccatacgcgccgcgtcaccgaaaggcgatgctgacacacggagcgccgcgttggggatcatccccataatcgccgttgtggagagtacatagcagacggcggcgatcagtaccccgccgatggtggcgataggcacgttgcgtttcgggttttttaccacaccggccgcaacggaggcgctttctaccccgatgaatgaccatagcgtgacgttcaacgtgctttgaatcgcgccgaaggtattcataccgctcacgttccaggccgccatataggtttcgcctttaaaccagaaccagccgaagaccgcaatccctacgataggcaccagcgccagtacggtggcgacggcctgtacgcgggtaatcattttcggcccgacgatgttcagcagaacaaaaatccacagcaccgcgacgcaggtaagcgttaataccagcggatctttcagaatcgggaagaaatagctcagatagccgacgccgataacgaccatcgcgatattaccgatccagcatgccagccagtacagcacgttcgtttgatagcccaaaaacggcccgaagcagcggcgtgcataggcataagaaccgccgggactgggatctaaggacgacattttggcataaaccatcgacagcgccagggcgccgatgatagtgaccagccatccgtagattgcaatcccgccagtggccgccaggttggcagggagtaagaatacccctgaacccataatattccccgataccattaaggtgacggggattaggcccactttgtgagcatcagcatccgaagacataatttggactcctgaaaaggtgacttcgttacgataaattacgtcgtatcataccccctcagaatgccgctgaattatatcggagacgggttatcgccaatgctgttattatcgtgtcttatcgttgagtgtagaaaaattaggcagccgatcgttcccgatgttggctaacataatgcaggggggtcataccataaaactctttaaacacggaaataaagtacgacgtgctgttatacccacaaagctgtgagacttgcgagatattctttccgtccattaataattggtttacggcataacgcattcggcaggtcgtgattatttggctataactggtattctcgtttttgagctttttctttaacaagcttggactcaggcacaggcagctggcaacggcgctcagattccagtctttatgaatatcgctctgaatgatgtggtaaacgctgtcactgatgcggctgcgcagcatgtgcattaacaaagaaataaattttttgtggtcaagaaagcgggataaaacggtgaaaaggagcgcacgggtgcgttcactaacaatttcatccggtgtttccatcgcgctgtagcgggcggcgaccctgaagatatccggcgtcagacaggtggcggtcaataagggatcggcgttgcgttgccagacgggaaggtgtgagagatctttattcaggaattgtaaatagtctttaatattattgcgactcacttgtattactagcacgctatttaatgatgaaatgtcaataacgttattttcacaagccagaatggccatatgattcgcttttaaactgattggctccttaccatttactcgtaaccatgtatctttttcggttaataacactatgcaaggctcgttgctgcaaatcctcatacccgaactcctggaatatgaacataaaagaccggatctcgccaaacgggagagataacggggactgaatcaattgtgtgatgaattgaaactgcattaaaatagctttcctgaataatattacaatatttgtacgatgaattagggtgtacaaaaagttgtacgcgagtggaaacttgtcatttttgtataaaaaaagcgcgggatggggcccgcgcaaaaaggtatgacagtattattgttttgcagcaatactcagggaatacatgccatcctcaaaaaaagactctttgtgattaggctttcacgcacataacgtgatatacgccatcaataatttccgtgccttcggtttcatgctcaaagccagggaagtgatgatcccaggattgcagtgagcgtaagtaacccacctgcggactgttttcatcgccaaagttttcaccggagagcagcatcgggatgcctggcgggtaaggaataacggagttcgccgcaatgcgacccggtagattttcaatcgccaccatttcaatattgttgttcacgatcgcgttgtaggcgtcgcgcggggtaatctccgcaaccggcagggtggaataggcggcattgagacgggcgcccgggttattttcacgtagccaggcaaacattttatcgcccaggtcatgaatacccatgttcgcgtaagtgtcaggataatcctgcaccagttccggcatcacctgcgccagcggcgtattcgcgtcgtaatgatgtttgaaggagcacagcgtgttgatcagcgttccccatttcccgcgagttacccccatggagaacaggaacataatctggaagtcggtggtgcgggtcggcacgataccgtggcggccaagccatgctgtgaccagcgcagcaggtacgccggatgcttccagttcgccatcgtcgcccatacccggcgccaggatactgactttaatcgggtccagcatactccagttatccggcaggtctttaaagccgtgccaggtttccccggggcgcatgacccagcagttctggtcggttgccagcagttttgccggcgcgtcggcgaagtcatacgttttaccggtttgtggatcggtgacgacgtctttattccacggtttaaagaaccagtcgccttcatcggtaaactctttataaagacgcgccatcgcctgacggaaatcaaccgcttcgtcaatcacctcttgagtcagggacaggccgctgttaccgtccatcatcgataccgccacatcgttggatgcgcagatggcatataacggagaggtggtggcatgcatcatataggcctggttgaagcgggagaaattcaccgcgccacggccttcacggacgtgaatgtaggaagcttgtgaaagcgcgttcagtaatttgtgcgtggagtgggtggcaaacacggtcggaccgttatggtcgcctggctcgccgcgcatcgcgtagtgatcgcaataaatcgggttgaagcgcgcatagccgtaccatgcttcgtcgaagtgaatgcgatcgctggtttttgccagcagatcctgcgcctctttggcgttatagcatacgccgtcataggtacagttggtcaccacgctgtaagacggtttctgtccggctttggttttggtcagcgggctggcgctgatttttttctgcaaggtttcaggctgcatttcctgcgggtagattggcccgataatgccgtaacggttacggcttggcaccatatataccggtttggccccagtgaggatcagcccctgttcgatggatttatggcagttacgatccagtacaacgacatcattatccgtcatacaggcctgcataatagtacggttagaacctgaggtcccgacaaccacggaccaggagcggtcagcaccgaatacgcgggcggcgtttttctcgctttcgccaaacgcgccggtatggtcgaggagtgaaccgagcgtggtacgctcaatccccatatcgctgcggaacaggttttcgccataataatcgtgataaaagcgaccggcaggcgttttagtgaaaccgacgccgccctggtgtcccggcgccgcccatgaatattcatgaatgtcgctgtatttcatcaacgcgttaaacagcggcggtaacagttgctggcgataccgggtcatggcggcaacggcgcgtccggcgataaagtcagcggtgtcttccagaatccaggcgaattcatcgacaagctccagcaggtcgcggtccagcgatgccgtcgctttttccctgtcgcctaacaggaaaacgggcacgttttgctgacgctcgtgaagcttaccgatcaattgcctgacgctcaggtgctcatccggttgttccatttggtagctaaacatcagacagtcaatggcttcgttcgcggacaagatggcatagccgtcatcgaaggatgtcgatttaatgacggtaacattttgttggctcaaggcatccgccagacgctcaaccgcgttgccaacccaggtgtcctgatgcagaaactcactttcaacaattaatactttcatcatcttttacccggttgtggaggccgtgcaatttacgccttgccgacccgccgtatgaatgtgacgtgggcaagtattaccccgtcaaatagggggtgtaaagtgatggaataatggtcagttattgatattattgtttaataaacaatgggttaattattgatagcgagcaatttcacccgccgtttatcgacaggtgaattatttttttggctgatagtggtatccggctttagccgggcatcgtctggcgtcgttgctggcttagcttgcggtattgttgcggcgacataccgacaaatttgctaaaagtactgtaaaaacggctgctggatcggaacccggcagtcagagcgacatcgaggatcgttttgtcagtatcgctcaataaggcacgtacgtgattgatgcgcatcgccgtgatgtactgcttcatcgtcaattgcataacccgctggaatattcccatcgcgtagttagcattgagtttgacatgctccgcaacgtcgttaatggttagcgcctgatcgtagttatcggcaataaatcccagcatctggcttacgtaaaactgcgcatggcgtgagacgctattcttgtgggtgcgtgatgttttattgagcaaaatgggttgccagccggaaaggctaaagcgtttaagcatcaagccgatttcatcgatcgccaactggcgaatttgctcattcgggctgcttgtttcctgctgccagcgcaacacttcaaaggtgctaagctgctgggtcgccagtgatttaaccaccatcccgtgcgtgacatggttgataagatcgcgatccagcggccaggagagaaacaggtgcatcggcaaactgaaaatcgccatctggcggcagttgccggggcgggtaagctggtgtggcgtacaggcccaaaacagggtgatatgtccctgctttatctgcacgacttcattgttgattaaatactccacatcgccgtcaaacggaacattcacttctacttgcccatgccagtgactgctggccattctgtgcggcggcctcagctcaacgtccagtcgttgatattcggaatagagcgacagcgggctacgggtttgcttttcatcgccgttgcacatgtgcgggtcgggcgggaggagggatattgcttgcgtactcatcgtcactccatttcctgaattatcagaattatgcccctttagccgggaggaaaccgggaatccggacacagaatccgtcgatattgtagagcgtagcctgactatcaggccgaatactctgctttttacgccattttgtcccaaaaactcagatctcccgcgcgccagcatacgatctgagttttcgggaatgctcatcggggaagacggaggttttcaccgggaacgcgtgccaccatgaaggtgttcactactgttctggagagtcatgatgacggcacccaaaattacctttatcggcgcaggttctacgattttcgtcaaaaatatcctcggcgatgtgtttcaccgcgaggcgctaaagtcagcgcatgtcgccctgatggatattgacgaaacccggctggaagagtcgcacattgtggtacggaaactgatggactcagcgggcgcttctggccggattacctgccatacccaccagaaagcggcgctacaggatgcggatttcgtggtggtcgcctttcagattggcggctatgaaccctgcaccgtgaccgattttgaggtttgtaagcgtcatggcctggaacagacgatcgccgatacgctggggccgggcggcatcatgcgcgcgctgcgaaccatcccgcatctgtggcagatttgcgaagacatgacggaagtctgtccgaaggccaccatgctcaattacgtcaacccgatggcgatgaatacctgggcgatgtatgcccgctatccgcatatcaaacaggtcggcctgtgccattcggtacagggaacggcggaagaactggcgcgcgacttgaatatcgatcccgcctcgctgcgctaccgctgcgtcggcattaaccacatggcgttttacctggaactggagcgcaaaacggctgacgggacttatgtcaatctctatcctgaattgctggcggcttatgacgccggacaggcgccgaagcccaatattcacggcaatgaacgctgccagaacatcgtgcgctatgagatgttcaaaaagttgggctacttcgtcacggagtcatcagagcattttgccgagtacacgccgtggtttattaaaccgggacgcgaggatctgattgcgcgctacaaggtgccgctggatgaatatccgaaacgctgcgtagaacaactggcgaactggcataaagagctggaggagtataaaaccgccgagcgtatcgacatcaaaccgtcccgcgagtacgccagcaccattatgaacgctctgtggaccggcgagccgagcgtgatttacggcaatgtgcgtaatgagggactgattgataacctgccgcagggaagctgcgtcgaggtggcttgtctggtagatgccaacggcattcaaccgacgaaggtggggacgatcccttcccatctggcggcaatgatgcagaccaacatcaacgtgcaaacgctgttgaccgaagccatcctcacggaaaaccgcgatcgcgtgtatcacgcggcgatgatggaccctcataccgcggcggtgctgggtatcgaagaaatctatgcgttggttgacgatctgatcgccgcgcatggcgactggcttccggcctggttacgccgttaatctccagccgcgctggacggcagatccggcgtttaacctctactaacagaaggcgggcgctggtaacagcgacccggtaccctatgagcatctctctgacaacaaagctgagttacgggttcggtgcgtttggtaaggatttcgccatcggcattgtgtatatgtacctgatgtattactacaccgatgtggtgggactctcggtcggcctcgtcggcaccctctttctggtcgcgcgaatttgggatgcgataaacgatcccatcatgggctggattgtcaacgccacgcgttcgcggtgggggaaatttaagccgtggatattgatcggcaccttaaccaattcgctggtgcttttcctgctgttcagcgcccatctttttgagggaaccgcgcaggttgtatttgtctgcgtaacctacatcctgtggggcatgacgtataccattatggatatcccattttggtcgctggtgccgaccattacgcttgataagcgagaacgcgaacaactggtgccgttcccgcgtttcttcgccagtctggctggcttcgtcactgccggtataacgctgccgtttgtgaactatgttggcggggcggatcgtgggttcggctttcagatgtttacgctggtactgattgcgttctttatcgcctcgactatcgtgacattacgcaacgtacatgaggtgtactcctccgacaacggtgtaacggcgggccgcccacatctgacgttaaaaacgatcgttggattgatatacaaaaacgatcagctctcttgcctgttgggaatggcgctggcgtataacatcgcctccaatattatcaatagctttgcgatctactacttcacctatgtgattggcgatgccgatctttttccctattacctttcttacgccggcgcggcgaatctgctgacgctgattgtcttcccccggctggtgaaaatgttatcgcggcggatattgtgggcgggcgcctccgtgatgcccgttctgagttgcgcagggctcttcgcgatggcgttggcggatgtccataatgccgctttaatcgtggcggcgggtattttcctgaatatcgggaccgcgctcttttgggtgcttcaggtaatcatggtggcggatacggtcgattatggggaatttaagctcaatattcgctgcgagagtatcgcttattccgtacagacgatggttgtgaagggcggctcggcgtttgcggcgttctttatcgctctggtgctggggctgattggctacacgccgaacgtggcgcagtctgcgcaaaccctgcaggggatgcagtttattatgattgtcctgccggtactgtttttcatgatgacgttggttctctacttccgctactaccgtttgaacgacgatatgctgcgcaagattcagatccacctgctggataaataccggaaaacgccgccattcgtcgaacagccggatagcccggcgatttctgtggtagcgaccagcgatgtaaaagcgtgagcatggtctctcgtgcaggccggataagccggataagcgtagcgccatccggcaattaaccgataacgcggcccgggagaacgccgggcctgccaggttatttcgcgcagttagcgcactgtttgctgacaatctgctggaagaaatcgttgcctttgtcatccaccagaataaaggccgggaaatcttctacttcaattttccagatagcttccatgccgagttccggatactcgacgcactccagatgcttaatgctctgctgtgccagtaccgccgccgggccgccgatactgcccaaataaaagccgccgtgttttttacaggcatccgtgacctgctgactacggttgcctttcgccagcatgatcatactgccgccgtgggattgcagtagatcgacataagagtccattcggcctgcggtggtggggcctaatgagccagatggataacctgccggggttttggccggacctgcgtaatagatggggtggtctttaatatactgcggcaggtcttcgccggattcaatacgctcttttagcttcgcgtgggcgatatcgcgacctacgataatggtgcccgtcagcgacaggcgagtcgagaccgggtactgcgatagctgggcgaggatctctttcatcggacggttaagatcgactttcaccgcgtcgccttcgcccgcctgacgcagcgctggcggaatatactggcccggattgtgttccagtttttcgatccagatgccttcgcggttgattttcgctttgatgttacggtctgccgagcaggagacgcccatccccaccggacaggaagcgccgtgacgcggcaggcgaattacgcgaatatcgtgggcgaaatatttcccgccgaactgggcgccgaggccaagtttttgcgcttcttccagcagttcctgttccaggtggagatcgcggaatgcctggccgtgctcgttaccttccgtcggcagcgcgtcgtaatagtgggtgctggcgagtttaacggttttcagcgtgctttccgccgaggtgccaccaatgacaaaggcgatatggtatggcgaacaggccgcggtgcccagcgtgcgcattttctcaacgaggaagtttttcagcttgcctggggtgagcagcgctttggtctcctgatagagatacgttttgtttgctgaaccgccgcctttcgccacgcaaaggaacttgtactcgtcgccatcgacggcatagagatcgatttgcgctggcaggttgctgccggtattgacctctttgtacatatccagcggcgcgttctgcgagtagcgcaggttatcttcgatataggtattaaacacgcctttggagagcgcggcttcatcgccgccgcccgtccagacgcgttggccttttttacccatgataatcgccgtgccggtatcctggcaggtcggcagaatgcctttggcggcgatctcggagtttctcaggaattgcaacgccacatatttgtcgttttcgctggcttcggggtcatggagaatggcggcgacttgctgctggtgttcaggacggagcataaaagacgcatcatggaaagcctgctgagccagcaacgttaacgcctgcggctcaacgttgaggatagattctccattgaattcactgacgctgacataatcggaggtgagcagataatactctgttttgtcctctcccatcgggaaaggcgcctgatagataaactcttttttcgacatgtgcttccagcctaatagtaagaaaatgtattaagagcctcatgggccaggctctaagtcgcgcgccgcgcatagccgggcggcgcgcgcggccattacaggaatccgtacattgcggcaaagatccagccaaagacgcaggagacgctcacgccaatcaaacccggcagaatgaagctgtggttaatgacgaagcgaccaatacgggttgtgccggaacggtcaaactgaatcgccgccagatcgcttgggtaggtcggcaggatatagtagccataacatgccggcgcagaggccacgatatacgccggatcgacaccgatagccagcgcgacgggaacaatcgccgccagcgccgctgcttgggagttaacaaacttggagaccagcagcagaacgatggcgtaggcccacggatactctttgaccatttcgcccagcacgccctgaatttccgacatatgcgcgccgaacatggtttccgccatccaggcgatcccgtataccgcgacaatcgcaatcataccggaacgaaaaacttcgttttttgagatagacgcaggattggttttggtcagaatgataatgagtgccccggtcagcagcatgaacatctgaatgaccagcaccatcaacaacggtttgccgccgaaggttggacgtaagtcggagtccgcgcccaggagagcgaccacggcaatcgccgccaggaagatccacatcgccagccagttgcttttcggcagttttttatccagcagcgtcgcggtatcgccgtacacgtactgacggttttccggtacggagataaatttctgaaacgcttcgtctttatccagatctttaccgcggaaccaactaaaaataccgattgccaggataccgagcagggtagacgggatggtgatcgacagcagatcgaggaactccagatgttttccgtcaaatgtcacgttgcccagcatcgctaccagagaaaccacggcgacggaaaccggactggcgatgatacccatttgcgcgccgatagaactggccgccattggacgttccggacggatattattcttgatcgccacgtcatagataatcggcaaaatggtgtaaaccacgtggcctgtcccacacagaatcgtcagggtacaggtgacgaacggcgccacaatagagacgtatttggggttgcggcgcagcagcttttcggcaatctgcaacatcacatccagcccgcctgacgcctgcaacgtcgccgacgcggcgactaccgcgataatgaccagcattacgtcaacgggcggtttacctggctggagatggaaaacaaacaccagaatgaccagaccgataccgcccaacaacccgagcgcgatcccgccctttcgggcaccataaaacagacatattaatattatgagaagctgtatactaaataacatttttatttatcctcgcgataaacccagtcaattttgataaatggatcacagccatcttctgatttgtgtgaatgagcatcaggaaatggcgaatattcaatgcgtcagtggcgacgattaacgattaagctttttacagagttgctttaagtaattattttcttgcgatggtgatgttcagagggaagcaccctctggcgatgggcaggtggagtcagcgagagcagtaaattatgatttgtctgttttaaaaacaggcgtttattatttaatttttgtgtctcgccatcaggtaaatcacgagataaattgaacagaatgtgacttatgtgatcattgtcacgccatttttttaaattattagtatggcgtgtggagacgcgtatctgctcaccaatatacgtattgtccataggcgtagcacaagctccattgctacaaacataattttatttaagtgtcaggaaaattccggacaaatcccttttttaataaaaatacacactctcggcatgggataatacttaattaacttttgttatcgttttgaaattaaaaacagcgcatagcgctgtaataatagaaaataacgttaacaggcctgggttgagtatatttgatctgacacaatttcccaggtttgttattaatgtgatagcgtttttattggcattgttataataaatgttaccaagatataacgcttcgcgtcggctttatgcggtatccttactgacaatattgtttcagtaaagagtaatgttccggctgaacgcggtagcggtaaaccggcctgccggtcacgccgtaatgaatactggtaaacaagatatggcaattcaccagccagatgagatatttacggcaggagacgcgcgagatattcacttcgttggctaactcgtcggtagaaaattcctgctcctgatgcgcatcaatccactggcataaggtgcgtagcgtttgctgggtcagcctttttggcagccgacgaggctcctgctcgctggatgaattaccgtgaatgagcaggtcaagctcagactgttcgtaatactggcgtttttccatcgccgttttcttacgtagccagccggtcaacgcttcttcaaagcgcgtggcctgaaaaggcttgatcagataatccaccacgccgtagtgaagcgaatctttaatggtggcggcgtcagcggcagaagaaatgacaataacgtcgcttttgcagcctgcgctgtgcaggacaggcagcagatccaatccgttttcctgctgcatatagatatccagcaggattaggtcaatgtgattttcactgttgaagataaactctttcgctttttccagcgtcgaagcggttccacaacaatgaaaaccggagatttgcgcgacatagcggcgatttaactccgcgaccatcgcatcgtcatcgacaattaatacattgatcataggctggtcctttttccatcccagggtaactgtacaaaaaattgtgtgaagatcccaggctcggactccacggaaattacgccgccaagcgcttcaacctgctgtttaaccagcgctaaaccgacgccgcgttcggcgcctttcgacgagacgcctttttcaaaaatcgcctcgatgcgctcaggttcgatacccggaccgtcatcgctcacttcgcaatgcagccagccatgacggtagtgtaacgagacgctgatttcgccgccggattcctggctcaacgcttccagcgcgttttcaatcaaattacccagcgccgtaatcagcaccgtaacctgatcttcattgttattatccggtaactggctgtcgctgcttatcaccaggctgtgcccgaaatcagaggcgcgggtaatcttactgagcaaaaagccagcgataatcggcgactttattttacccagcagcaaaccgatctcttcctgatagttattggccgtcttgataatatacgcttcaagctgcttataactcttcaggtgcaataatcccagaatcacatgtaatttgttcatgaattcgtgggatcgttcacggagcgcatccgcgtagttcaccatcccgtctaaccgctgcatcagttggcgaacttctgttttatccctgaaggtggatatcgcgccgataatttcgccgttgctgcgcaccggaacggtattcaccagcagcaggcggcctttgacgataatctcttcatcgcggcgcggcgtaccgtcacgcaacacttcgctaatgtccaccacctgcggccaggcatgactcagggtggataatctggcgtcatcctgtgtttttcgataatcgagcagcgcctgcgccgcgtggttaatcaacgtgacttcgccgctaccatctacggcgattacgccctctttgattgactgcagcatcgcctggcgttgttcaaacagggttgagatctcatagggttcgaggccaaacaggatacgttttagcaccttgaccagcgcataggtgcctaataatcccaccagagcgccgaacagaatggaccagataatactgccgcggctattgttgatctgctgcgtaacgtgactgagttccaggccaatcgctaccacgccgatctgtcggtggtgttcatcataaaccggtgtgaaaacgcgcagcgctttggcaagaaagccgcgattaatggcaacgttttcctttccctgcagtgcgagcagaatgtcatcgcctttgaacggttgaccgattcgctgcgtttctgggtgcgaataacggatgccctgcatattggtcaccacaataaacaaaaagccattatgctggctcaccgcttcggagagcggctgaatgccgctttccgcaggcggttttttcagcccctcgcgaattgccggagagtccgccagcgagcgagccaccgccagcgctttatctgccagcgcgtcgcgcgtcatgctgctgatttgcgaaaaatagatcagatggaccacaacgagcaccgaaaacaaaacggcgctgaccatcagaatgacggtagtgccgagtttcatggggcgtttgcgtaacgcccggcatggcagggagtgtttcatagtggacctgagcggacgaatcgtaaggttattatccctgatgaggcgtctaattcaaaggcataggcgatgttgctccagtgttgaaaagcccgtctagtcttgcagggggcgctacctgctcatgtcgttaattaatatcgccggataccgtgatgggtaatttattttcatcagaattacataaaataatttttcattaatttttataataacgtatgcggtatcacattttatttttactgacgttcagaatgcgtttgatcacaatcaatcagcgctaatatttaatctattatgattagtttttattacatattattaataattatggaagcaatgtgagaaataaaaaatggaaataaaaaatggctgaacacaaccataacccgacgtgatgctattgtcgctactgcaaaagtaggggcggcggtgacgctaagtcaggcgattacgctgccttttgctaccactgcccaggcgcaggataccccgataccgaaggatgccaacggcgaaaccgtcaggcacagcgcctgtctggtcaactgtggcagccgatgcccgcttaaggttatcgtgaaaaatgatcgcattgtgcgtattgaaccggaagacgcgaaagatgacgcggtattcggcgagcatcagattcgtccctgcctgcgcgggcgttccagtcgctggcgcgtttatagcccggatcgcattaagtatccgatgaaaagagtgggaaaacgcggcgaaggaaaatttaaacgtatttcatgggatgaggccacagcctttattgcggcggaattaacgcgcgttagcgaaaaatatggccgggaagctatttattataattatcaatccggcgcgtattatcacacgcagggtagacccgcctggataagattactaaatctcaccggcggttatttaaattatcacaacacctattccacggcgcaaatcgccgccgccacgccttatacccacggtgattatgtcggtagccattttacgcagatcgcgcattccgatctggtggtgctatttggcctgaatctctcagaaacgcggatgtccggcggcggtcaggttgaagagctgcgccgggcgctggagacctcgaaagcccgagtcattattatcgatccgcgctataccgattcggtgattaccgaacacgccgaatggctaccgattcgcccaaccacggacgccgcgctagtcgccggcatagcgcatacgctgattaccgaacagcttctcgacgaggcgctggtaaaccgctattgcgtcggctatgaccgtagcaccttgccggacacggctgcgcctaacgccagctataaagattatgttcttggcacgggcgatgacggtatcgcgaaaaccccggaatgggcggcggatatcaccggaattccggcaacgcgtattcgccaactggcgcgcgaaatcgcctcgcgcgcgcctgctatatttgccagggctgggggccgcagcgtcatgccaacggcgaacaaaccgtgcgtgctattcagacgctgccagcgttaaccggccacttcgggcggcccggcaccaataatggcaactggccttacggtacgccgtatggcgtgccattgttgcctgtcggtaagaatccgatcacaacctctattccttgctatctgtggacggacgccattcagcatccggagaaaatgaccgcgacgacaatgggcgtaaaaggcgcggacaggctaaaaaccgggattaagctgtttttcaaccaggccggtaatactttgcttaatcagcacggcgaaacaaaccgcacccgtcaaattctcgcggatgaatcgctgtgtgaaaccattatcgtgattgaaaaccatatgacgcccagcgcgatgtatgcggatctgctgttgccggagaccagctatcttgaggcggaagacctggtggacagctcctatgcggcaggatcgcataactatatgattgcgattcagaaaaccgttaaaccgatgtgggaagtgcgcagcacgtatgacatctgcgcggatatcgccgggcatcttggactgcgcgagcaatataccgagggccgaactcaggcgcagtgggcggagatgcactatcagcagatccgtgaaaaacgtccatacctgccggagtggagcgtggcgaaagagatgggcgtgattgaccagcgtatcgctaccgagcagcagagccttgcgtttgctgatttccgcgccgacgccgaggctaatccactctccacgccgtcgggcaaaattgaaatttactcctaggcgctggcggatctggcgcaagcgtggacgttgccagaaggcgagcgaattcccgcattgccggaattttgtccagcgaaagagtcgcaccttaacaaagcattgacggcgaagtatccgttgcagttaagcggtttccataccaaagggcatacccactcgacctacagcaatgtgctgatgctgcatgaggcggtgccggatgaagtctggattaacccgattgacgccagcgcccgccaactgaagtccggcgatcgggtgcatgtattcaatgaccgcggcgtggtggagcttccctgtaaagttacccagcgcattttacccggcgtggcggcgatgccgcagggcgcgtggacgcggcttgacggcaacggtgttgatgtcggcggctgtatcaatacgctgaccagccatcacccttcgccgctggcgaaaggcaatccgcagcataccaatctggttgaaattaaacgcgcttaaggagtgatgtacgatgaaacagtgtggcttttatgttgactcctcgcgctgttcaggctgtaaaacctgccaggtaagctgcaaggataataaagatctggatgtcggcccgaaactgcgccgcgtctatgaatatggcggcggaagctgggtgaaagagggggaaagctggcatcacgacacctttacctactacctctctattgcttgtaaccattgcgatgagccggtatgtgtctccggctgtccgaccggggcgatgcataaacgcaaagaagatggtctggtcgtggtggatgacagcgtatgcgtcggctgtcgctattgtgaaatgcgctgcccctacggcgcgccgcagtttgatacgcaggcaaacgtgatgcgtaaatgcgacggttgtcttgactgactggagaacaatctgcgccccatttgtgtggattcttgcccgcagcgagcgctggatttcggccctgtcgatgaattacgggcaaaatatggcacggagaatcaaatcgcgccgctgccttcggcgtcgttcacccatcctaacctcattattaaaccgcatccgaaagcgagacccacgggcgatacggaaggcgcaatcatgaacattcgggaggtgcgccatgcatgagttaccgctggtcttttttacggtctttacccagagcgcggtcggcgcgtttattctgctgctgattggcggcgcaatggggctggtcgcgccgcggcgtaaggctatcggtctgttctcggtgatgtgcctgtttgggattggcgtcgttgtcggtaccttccacgtcgggcaaccgttgcgtgcgctgaatatgctgctgcgcgtcggacattcgccgatgagtaacgagattgtcttgtcggcggcttttgtggcgctcggcggtctgggggcgctcggtttattgctgaaccgtgcgacgccgctgtgtaacgcgttggtctggttggcggcgatagtcggggtggtcttcttatacgccgttccgcagatttaccaactgccgacggtggcgacctggcgttcatcttacaccacggcaatgatgatattgacgccgttgattggcggcggcgcgttggcggcattgtttggcgtgcgccgtctggggctactggtcagcgtgttggcgattttggtgagcttttgtctgcgcccgggctatatggcgacgctgatgagcgccgatagcgctctgaccgccgcgcagcatagctggtttaccgcccaggcggtattgctggcggcgggcgtggtcggggtggtggtctgcgcgcgcctgaaatcgagtgctacggtgctggccatgacggctgtggtggttatcgcggcggagttggcgggtaggattgcgttttacaatctgtggacgctgccaatgtagtttttgcccggcttgtgccatgtaagcctgataagcgtagcgtcatcaggcgaaatatttcaggagctattgctatgccttcccgtgctgttttgccgcgtatcctcggcgcactgttttactactcccctgagaggccggaggtgaaagcgttgttcgattgtttgccaacgttgcctgagctttacccctggcgcgatcgcggacatattgaatcactgtgcgcgtcatggtcgctaccggatgatgatgcgcttacatggcaattttccgtattgtttgaaggccagggaaagatgcccgtcccgccctggggatcggtctatctggaaaaagataatttgctgatgggggaaaccaccgccgattatcgagcttttttacagtcgcagggaatggtattcactgaccgtgaacgcgagccggaagatcagtttggcctgatgctattagcctgtagcgatctgctggcgcaaggcgacaacgtggcggccaaccggttactggaggcgcatctgctaccctggggattccgctatctggaattgctgcaacgcaataccgttagcgccttctatgcccggcttgccatcgtagcgacctgttatctgcaggatgttcagcagcaacaggggctacaacctgagaagaaacggttgtttttctaaggtattggtcaggttttgacgacgtgccgtaatgcttgtgtcgccatcgtgcccgctgttgcgtcagcgggcacagtttactattacagctccggcgtctttttgaaaccggtcagcatcagcaccaggctctgttttgagtccgctggcatgaaatcgtagtgatttccctgacggtcgccgccgatataccaggatatttccgttttcccttccgctagcgctttgcgcaccgctttatcgacatcaaccatgcgatactcatgtgaatggtttagatataatacggcatcggaacggtaattgatcgccggtttattgttccatgacacgctactggcgtgccagtcactgctggtcgggtaaaagaaaatttgatcggcgccgttcgtttccgttttgccgccaaaaaggcgaatacggtatttgaatagcgaagcgtccatattggcaggcaggggcgggatcttaaatttcaccagcgtgagcgtttccgggtgctgcgtgcgtccgccatttgtccagtcatcctgtacgtacaacgtatcgacgctggcatgaggcttgtcgtcttcgctgcttacccaggtattttcttccgctttactgtaggcgtaaggaaccgcagtgccgcaatccagtccctgattcatacacagatccgtcataaactgcgcgccatcttccgtccagccattcataaaatcggcatgggcggtataaatacttccccagcgctcttcccgggtttcgccatgcattaccgggtccatcgacaattccactttggacgtatccagcgaggagatctgcgggagtacccaggcgatgttcatattaaccgtcgggattttaaccggatagtctgcggaacatttcccgtggtcggcatagatagcattattgtggctatgtgtcggtttcaggttgacgtcatcccaacagttggggaaagcgatcccgatattaaactggacggcatcgcccgctttacgcaggccgcatatttcgcctaccttgttggtgtaacctttgccgttggcacataaaaaggtgattgcggaactggggccagtaccgtgatgatcgcctgccagtaactccagcccggccgggaatggatggagcggatattgcgctacatttgtggattgataataggtcttttggtaggccggatttacgatttcaccatcgggtaatttcatggacggtgcccagtaaccggagctgtcggctttattatcacaggtggtatcgggttgcgcgcgcaacgtctggtaggtagagaccgcgtcggtgtgggtgttgccaaaaaagtcatgccacatcgcctgattcgctttaccaaacatcataatcgcgtcatcgcccagcgtgtggtgatagccgcacacgacatgcgcctgaggaccggcatgggccgggaatgcgccagcggcaacgagcgtagccaggctgacggtaataaggttgagtttcatttttttgctgcccggttgaatagaagtgggagcagcaatagcagatcaaattacggtgttacatctcattaattatcactttttgtcatttgccctgcatacaggggcgaatttgcagacgtactatttaaataattagccgaaactaccctcctcttgattatgtcaatttacaaaaagggtacgttagtgattaaaatcgggctttttgtgataaccctcactatttcattttgcctatgctaatggcgctcgccataaccgaataacgattctatcggacatcggctttatttttaagaaatgcgttacgacatcagtcgtgacgcgatctgctatggattttttatgagattactaaaacgcgttattgtggttgtactcttgggcgtgattttatttatggtcagggacgatatacgctatgtttatcaactgatcctcaaatatggtgataaaccctcggcgctagcactgagtagctataaagcggttattcagcaaaaaccagtcgcaggagttaagagtaacctttcaggtttgacctactccgccgaagacaggatgcttttcgccgttattaataatccccctgaactggtctggttaacgacagaagggcagctggtagggcggatgccgctgcagggcatccacgacccggagtctattgcatggagtgggggcaaccagttccagataggcagtgagaaagatggcgcggtctataaaacacaggtggatattcagcgcggcgctatgcagataatctccatggtgaagcttgagggctatgacaaagcaaaaaataaagggctggaaggtacggcatgggatgcgaaaaatgagagattatatgccgcaaaagaaagaaaacccattatgatcaaagaagtagagatgagcaaaaatggtatcaccagagcgttgccttctgccatcactgcgagtgtgagcgatgtctccggacttgaataccatgccccaacggattcgctgctggtgttgtcggacgagtcaaaaatgattctggaggtcagttccgagtggcgggtgcgcgatcgattgttcctgacggcggagtggtcagggctcagagacgatataccccaaccagaagggattgccatggataatgaaaataatttgtatattgtgagtgaaccaaatctgttttataaattttcgtgtgatatacagaatgactaaaatctatttttactgtcacagcatgctaaaacagaacaaggttgttaataccatgatttgacgattgcttgatttgttgattcattgttggggatatttatgttttacttacctcagtaacggattactttgtggtgtagcgtaacggtaattgtcctcctcatatttgcggcagcgtagtctgccgcttttttttataaattaactctctctgtaataattaacagacaatgaatattattctgttttttcaggaggcctccgaagagacctcgcatggtgatgtttagttatcaggcataatcatttcatctacgccggaactcttgttgaccggattttccgtgggcgatgtacctgtaaatgttacactggcggcggcgctattaccggcgggatcggtggccgttatggtatactgattctcccccgacagaatagcggattgcggaacagaaacatgccagttaccggtatcgttatcgacactggcggtgtagtccgtatcgtcgaccgtgaccttcacctgaatatcctgatgcgcctccacgactcccttaaggctgacggtattatccagactgctaacagtcgatcccaacgttggttcggcggacggttgtgtatcaatagtcagcttaattgttgcgtgagcttctaagcgacccaataaaaggtcggtgtattgatgttagtgatattatcgcctccggcgccaatatcactattattcttcatggaacgtactggcggtgtagagtctatcgtcagccagccgatagacagcgaagaattatccatagcgtttgcggaacgatctctgaagatgatatccagagttgccttgcctaccattctagcaacattttagaaaaaattacgtaatatcgactgatatgtaaaactcattcagcatcaaatggattaattcaacatcagtagtaatatccatttttttataggctgatctcttttgtgttgaaatcgtttttatatttcgatctaataaatttgagcaacttttaacagataatcctgcagccacgtaataaataacttttttctcgctcaatgttagatcgaattttttagcgagcaacagaattccatctcttatattaatatgttttgctttgttcttatactgcattgtcagatatctcaattaacatattgatgacgagaggaggataaaaacgctaaaaattccgatggtgtagttttgaaatgttttttaaaaacgcatgtaaaataagaagcactatcataaccacacatataagccactcgagtaatattatattcactattgcgtagaagttttgtcgctttattcattcgcgcattaaggtaaacttcactgaatgaggtgtgctcttgtttcaatttcctttttaatgtggaacaactcatatagagtgagtcagaaatatccttgagcgcccattttcgacttatgtcgcttataataatattatagatgttttcggctaatgtattttgcgatagttctctgaagagagcaaatgcttcaggttcatagatgaactctgaaagcagaaatcttattaaatattcctttttatcttgggataatttctggcttttatttgaagagtgtaagaggttgaatactcttgctacgcctgtttctattggcgctaacagatgttttgtcgtcggttttgttaatggggccgaaaagtctgcatgttcatacagaaaaaaattataagcattttttattgacgctgaatctaattcaattaaattataatttaactgttcatgagtctcttccatagtgatatgaatggtttgatctttagctaaaaatattaacattggccctgatgccgtaatatactccccggacgatgtcgtaattgaaattttacccgtggtgagcttgatgagtacggactgcagtaaatttaatccctgaagtgataaggatttcctctgccagttttgcgctgattgtaaacattcaatgctccccacctggacaggtgagggattaaacacctttagcatgataatttccttttattaaatgtgcgtgtaaatcaaaaattattctgaaaaatatttcaaaagaaaactaatatatagctatataattatttgcgaacttaaggtatcaggtggcgatcttttcattttctatggaaaatgctattttatattgcatttctacctattatagtatcgttaaaaaactatgtcgcgtataaaaaaaagatggaaatatacaagaattggctcatgttattatcaaattatctctttaaaatttgaattaagtaataattacccttattcttttagagaatagctctttaatttcatgggggtagttagcatgaggtataagatctgatgttaatttgtgataaggtttatcttggaggtaaatattaacgatctcggccaggaaaggcatacaacgcggtaaatatatactgcggcgggtagacggtgtaacaatatccggaagtttgagggggaggggaaacattcaatcgtatggttggctttatgaaaaacgatgtaacacgttattgaggttcttactgtgcgtatccgttaggtttatgctttctgattatataatgttgcgtgttttggcgcggcagtattgaatcttttgctgcgtcggccccgaggaggaatcactcacagcgaatgccagcgcacagcctggtactgaatctataaatgagtagaaaacctttcggttcgctactccggttccattccttctaaatttatcgtaatgacatctgcgttacgcgtgttgtatacttaatatccacagaagtacaagaggacaacactatgccagccgcaaacagtatggcgatgaaacgtgaaactctgaacctgcgtatcaaacccgccgagcgcgatcttattgatcgagcggcgaaagccagagggaaaaaccgcacagactttgtgttggaagctgcccgtgctgccgcagaagaagtgcttatcgaacaacgcatcattatggccgatccagaggcttatcaggaatttctcgttcgtttggatcaaacaccttcacctaatgccgcactgcgtaaaaccatgcagacccctgcgccgtgggagcaggaaaaatgatctccacccctgagccgcttcatgccggacatattcttactccgttttgctgcggtgtggattctatagataactggctgaaacagcgggcgatgaaaaatcagaccactggcgcgtcccgtacctttgtgtgttgtggcagcgattcgaacgtactggcctattactcgctggcgtccagcgcggtcacgacgaatacctcccccggtcgctttcgtcgcaatatgcctgacccgattccggttgtggtattggggcgtctggcggtggataaatcgcttcatgggcagggcgtcgctcgggcgctggtacgcgacgcagggctgcgggttattcaggtggcggagactatcggcattcgtgggatgctggttcacgccctgtcggatgaagcgcgggaattttatcagtgggtggggtttgtaccgtcgccgatggatccgatgatgttgatggtgacgttgggggatttggtggagagtgtttaaactccagaacgcatcccttagcttctgatggccggaattcgctgtggatagtcagtgagccagaccggttttaccgcttcagccggacaacgacgtcatgacggtctggacggactgcaaacggggacgttgaattcatgcgaatcggggaaaccaaaggcgttctccacgcccggtcgcccctacgcagttgcacttcctttcatttgctgtggccagtttgcgggaagactttcaccttcagtaattaagttcggggcgttcttctttactcaataaattatttttgtcgttcagctcctcacggacttttgccagtgacttctgaaaagccgggattgtttgcagccttgcaaactctactgctcccacataacggccagcatcaacatcgctttgccagtgagcaccgcatatcactctgctttgcccgaactcccatcctcgtctggcgagctcctgcgcgcgttccggtctggcctgggataatactaatgccagaagtgtactataagcagtatgcccggaagggtaagagccatcttttcgcaaagtattctcatcttcaggacggcaggtagaatgattaaataagacaaagggacgagtacgcatataatatttttttgccgaagcagtagcgtagtagccgcccattttcagaagattctgtaacatattccaggtttctggcgtatctttgggattaattttagcacccactactggcgagaatattctggctatattttccacgcttatatctgcatcctcagcagcttgtttccatcgtggggaaccctttatcgcatagcccttaaaataagcctccttatcatagcggaaagccggatcatcattacctggcggtggtggtaagtagaactgactgttcactgattcttcaggagaatgaaagggttgcattgttgctgctgatgtatatttagctacgatcagtggtagaaaaaatagtaaataacgacttttcataaagactcaccccggatcaggcaataataaacagatgtgattctataatgatttattgaaatggttattcaacatacaggtaaaaaagcaggacgctgcactggcattatcgtctgtccataccggactgactgtagcggacaacagaacaatactgatacttccggctaacagcattttgtttaacttttgtccccggttattttttatctgcgtgcctgactgacacgcattaggttaaaatctttccgtaataacacagtatgaataattattttaaagtatgtgctctgttaccccgataactaccatcagtcatgatgtactgagtattaatttatgattatgaacaagagtcggaaacagtatttaagaataaagaaaccgaaaaagaaaaaatgctaaaattggcgaaggaattgttgttgtcagtgatgaaaaagttcatggcggagatattggattcacttgtcgaggctagcgaaccgtcagatggagtgatacgcgttattactggtaataatctccctgtagctaagtaagcttttgacccaggcccaaagatgagcggctgatcgccgaagcgctgggcgttgcgccagagaaaatctggccttcccgttatagctaatcaggccagagatgggggctacggatttccattcccagaaaagcaaaaacccagccataggctggattttctgaataagtggtgcccggactcggaatcgaaccacggacacggggattttcaatccccttgtcaaaaagttagacaccgctttgactttttgaattggtagcaggcaggcgaacacattcgaataaatttcgagtgtattgcatgcaaactgtatctcgcgttaagtgttccccccaggtttcaaccggggagtctgtagaaagaaaaccagacgccagtattcatttggcacagcaggtttcaccgcattcgttgttactccctgatgagcaacaattcccggtagtattgccagtagtatccactaagggcggagaagggaagtcaaccaaggcaggcaatattgcgggttacaccgccgatgctggtctgaaaacactgctaatcgatggtgattataatcagccaacagccagcagtatttttaaacttcactatgaagcaccctgcggactgtatgaattactcatgcagactgctgaccttaacaaacctgacagcatcatttcccgcacggttattcccaatcttgacgtcatcatttccaacgatcctgacgatcgtctttccaatgatatgctgcatgcagctgatggcagaatgcgtctgcgtaatgtcctgcagcatcctcttttcagacaatatgacgtcataatcgtcgattccaaaggcgctggcggggtgatggtggagctcgtggtgctcgctgcgactcaaagcgtcatgggtgttattaaaccgattttacccgatgtacgtgagttcctacgcggcactgtacgtcttttatccaaacttctggttctggaaccctacggtatccatattcccgatattcgaattctcgccaactgtgttgaacccactgtactggatcgaaacaccctcaacgaactcaaggcaatcgtggataaaggtcagtacccccagtcagaccgtattgccatatcaatgctgaataccgaaatagagcaactggaagtctacaaacgtgggcatgcgtgcgggcagccagtacatcgtctcgaatataaaactgaccgggtaagcctgccggcagcggagtccatgcaccacctggtctgtgagttatttcctcaatggaaagataagtttgatgcggttctggttaaccggcctcagcccggatttggtcagggggcggatgaggtatgagccataaatctgtttctgcagtatccatgctgtttaatgtcggagctgaaaccggtgttctgggcggactgatgctcgataacgaccgctgggatgaaattgcgccgcttctgaattccggagatttttattatggccagcatcagatcatttttcgggagatagaacggttggtcagtgctggcctgcccattgacctgataaccctgtccgaatccatggagcgaaaagatctgctggagcggtgcgggggggtcgcttatctggctgaactgtcaaaaaacacgcccagcgccgccaatatcgttgcttatgccgaaattgtgcgcgagtacagtcgtaagcgacggctggttaagctggggcatgagctacatcaactggcctcagtcggcgatgcggatatacccggtctgattgaaaaggccgaaaagcagttatttagtctggctcagcaggcctgtgaccccgacatttgtctgagcgtaacgactcaggtcgctgacacggtcagctggctggaatcggtcagtgggggaagcggtgtgaccggtacagcgacaggttttgctgaactggatgagaaaacctgtggctggcaggacggtgacctgattttactgggtgcccggccatcaatggggaaaacggcagaagcactgaaacatgccgttgctgcgctggaaggcagtcccggcaagaccgttcagttctacagcatagagatgccaacccagcagctgataatgcgtctgctttcaatgctggccagagtgcccttcgataacctgcgcaaaggtctgctgagcgaagggcagtggagtttacttgcggatgccgtagcaaaactgacctcctgggaaggacgtttgctgatagacgataccagttatcagacgccttccacgttacgtatcagcgcgcggcgtaatgtgcgtaaatacggtcagccctcacttattcttgttgattatcttcagttaatgagttgtcctggccgggagaaccgcactcaggaaattcaggagatttcccgttcgctcaagtcactggccaaagagataaggtgccctgtggcagctttatcccagctcaatcgcagcgttgaacagcgtcaggataaacgtccgatggtcagtgaccttcgggattccggctcactggagcaggatgcggatgtcatcatgttcctgtaccgcgatgaagtttataacgagcactccccggatagaggcatagctgaaatcattctgggtaagcaacgtcaggggccgctgggcactgtcaaagttcgctttgagggggagtatatgcgcttctcggagtatcaccttggttatggggaggtgagctatggctaaagcaccactgttaaatcttaataatgcgctgctacagggggcgaaggaatcatctgcagctacaaccgctgctgttgcgattatgccgaccagtgaaatgccgatggtgctgacgctcgatgaggtagctcctaatccggacaatcctcgcacaacacgcaatcctaagtacgatgaaatcaaggaatccatcagagcccgtggtctggatacggtcccgaaagtgacgaaaaacccggatatccccggctctccttatattttcagcgatggtggtaacacccgctacgccattctgcgagagctgtttgctgaaacacaggatgaacgcttttaccgcttccatgctctgttcaagccatggcctggcaggcttgaatgtctggtagggcatctggccgagaatgatgtaaggggggatctaacctttatcgacaaagcgctgggaataaaaaaagcccgcgccattcatgaagaaactcttggacgaacggtaaccctgcgagagctggcggacctgctcggacagcagggataccccattcacaactcaatgatcagccgtatggaacatacggtggaatatctttatccctttatgccggagttgctggtttctgggttaggtaagccccagatagttaatttattaaatttgcgagctgatgctttaaaaatttggcagcaatattcggtgatgactgagactgatagtgattttaatgagattttcggtcatgtctgtactcagtttgacgatccggaggtgtattccttcgaaatgttcagagatgagtttatcggtatgttggtgaatgttttaccacacccttctcttaactatgatcggtggctacttgagctggatcctaaggcacgtaaccagagaaagttatttggtgagccagaacctgtggcatctcatctggtggatgcagatcgccagacatggcagagcactgcatcattgccgggtactgcaaacgatgagaatcaacaaggcggttcctctttaaaaccgaagctgaataacgcccctgtcttacctaaacaaccagatccagataatgacaatggggataacgatgatgtgaccggcgaatggttcggttcttgtggatcacctcgtttacctaaagctgaagtccagaacgatttcctcggggggccctcagttttaaccggtgatgttattcctgatgagtaccactttattcccgacgccggaaatatcgctgtcagtgcatcagctttcgctggcgctcaggtgggattgactgcggatactccttctgacgccgttagtattgccagcgagatgccgggtctctcacttttacccacagaaccagcactttcctcagttgagtttgccaacgtagggctcgagcctgttactgatatctgggtcattccggctctgcaggatgatatcgaacatctgcaggacatggcttaccggcttgcttatgaacttgcagaggcgatgggctgtgaggttcatgtcagtgaagataaaaatgccagtgcggccgggttctctgtttcagaacacggcggagaatttgctctttttctggcagggctttccggtcacgtgccgaataaacaattcaacatgtttatgttctgtctcaacttctttggctcccaatcagcgggagatacgcctgtttttgacgatgtgcatgtagtgaagagtctgcgccttattcgtgttattcgccgtctgcgcgagctgcagagaaatatggcggctgaacaaaatgacgggaggaggcatgagcattgatgttgatgattcgatggctcagaacgaatcgcaggtaaacattgacaacaggtttgccgaaatccgggctgctcttcggattaagggacatgtatcacgacgacattgtcgggactgtggtgatgaaatccctgactcgcgccgtgagtccatccccggggtaagcctgtgcatgtactgtcaggaatggcgagaatcaggagacaaaaaacaatgaagagtctgaaaaagccccgctcacattaccagtgggtcggtgccacggttgtcaccacacaggagctgagcagtggactggcggttattcctgtcggaagtcgaggcgtagtgaatgcagcaaagcgcgggctgtcggtaatatttgatgcctgcccgtgttgcggtgttcagctaaggctgacccgtattcgtcctgagatgcttgatattgtggcatatccggaaattgaggaggtgactcgtgtcggcgaatgaaaaagttctttcacgtatcaagaagctaatggtactggccgaaaaaacaggtaatccctatgaggcatcagtggctttacggcaggcccaggcattgatgatgaaatacgatgtaaccccggcgagcgtggtaccgggagaaataacaagtgagacctgcaggaatatccccagtaatgctctttcggttccgggttggctgaatgctctggttacagtggtttgcatgaccgcgggctgtcgcagctattacggctggtatcagaacagtgatcataagaagcgtcgcagcgtaacattttacgggcttggtgaacgtccggcggtggcgggttatctgtttggcgttgtctcccgtcagttgaagcgtgatgccgaacattatctccataccgcgtgcgcacatccgttactgaaactttccactatccgtcgccgtatggatgaataccgtttgtactgggtggccggagtatggacggttctggagtcatttgaacctgaaacatcagaaaaagttctactcgaccgctggttaacacagcagcagcgcaatctgacccctgcgaaagtacggcagccggaagggtgtcgtaacgccaaaaaagtgaggcaggctgcatggacagctggtaggcaggctgagatttatccggctatggactatcgcagtgaggagcattcgcttcaggaggtatccaatggttaacgttctggcgtttattctcgctccaggggcctgtaatcaattaattgtcttggataatgaaagtgttcacgttcaggaggcgatatgactttttcacttgcacagggtgccaacagtcttttgttcaatctggttatggaactgagaggtggaaatattcggcgatgtgaggcgctggggttgaaacctgaagaaatgcgtctcctcagaagtctgacgatggaagaactgcattatctgtcaggcagccctgtttctgttttaaatgtagcaatacatcatgaaaatctaaaacgaatgctggaccaggccaatcgtgagcaaaagcgtagcgaacgaattgatcgtgctattgctcttggtgcatcaatagagatgatggggatcttctttggtctgaatgcttcagatgtcagttctaaacggcggctcgaggggatccagacacgtcagggacgttgccagtcacctgatgaggagtgtgaagcgaagatatggcgtctctggcatgaggccaatatcagcgatatagaaagtcttaactctcttgaaactatgatgcttattgcggaagaggctgatgtcagtctcacggtgatctggggattaatcaaaaactggtgtacgggggaggtagcctgatggattcactggcaccctcctttcagttttaccgtactgacccgagaaatgtgagtaaagctgtcacgtcaaaggcgcgtacactgctttccctgtaccagcagggaaagcgagtctacagccagataggacagacaggttatctcaagattgatctgggattacgctggcgtctgctgagtaaggatgcaggtaaaagctggttatttatgtctcaccagacctataaccgggaactgaaacgatgagagacgcatcgataacaacagaaagaacgatgcaaactccggctcaggtgatggaagaacccggttcatccgttcaccgtttgcctgcagatgatatcattgactacaccttgtcgaagatgcaggcacggcttgacggtacgccggggtcgtcggggcaggagcgtaacgggctgctgtttacaggtaatattcacgacgcctacccgcgggcgctaatcctggatatgcgcctttctcctctggataaaatgtgctggataatgatacggcagtatgccctgcagaacgacggcgccatcttcccctcatatgatgaacttcagaaactgctttcttcccccggttccggacaggcgtcacgcgatacggtgagccgtgcgctgaccatgcttcgactaacgggctggttgagtttgtgcaagcgggtgcgtgataccgggggccgggtacggggaaatatttacgcccagcatgatgaaccagtcagtgcgaaggatgcagagatgtttgacccgggatggctggatatggtgggtaaagcctgccagcacaaatacagagaggtcagcgacacggcctttcatgtactgaacgggatacttgatgatccgatgatgcgtcacaggcattcgcggatgacggaaattgcggaacgtctgacccgcccgtccaaggtgggtgatgttgcccgcactcatcaaaatccgggtaccggactcagtctgaatagcataaaaaatgagcataaatcacttagtccggtaaacagacccagtagtgagaggggggagaaatcaccgagtccggatagcagactcagcctgaaatcagacagttacgacagagtccggcaaccggactgcaataacgtacgttctttcacacaaagtgtgattaaaaaaacgtacgtatctccccagagtggcaaaaatgcggttgccggaatacccgaggggttcgtgtggcctgatggtctgcagtccatcctgccggaaagtgaacaacccatgctggctcaacagttgaatcagcttgcacagaaatcaccagttcaggctgaacagatcgccctcagcgtggtgaatggctggcaccagaaacgtatcagcaatccggtgggctacttgctgactacactcaggcaagcgagggcaggactgtatcgtctggaacctgctgtcactcagcctgttaagagcagatctgtcgtgccagctgagccatccgctgccgggaaaatcccgacatgctcagctgaagctgatgtccctgcaggtcaggaagtcgtgaaggcgatggtggagcaaattcgtcagagaatgaattcctctcaatgactggttaaaaaatatactttgctgccagtggcagcatggtacaaaaaatgaccagaaactgtatttgggtctgccagaaagtgtgttggttaaaaaatgagctttgctgccagtggcaacacggtataaaaaatgaccagagactgtatttaggtctgccagaaagtgtattggttaaaaaatgagctttgctgccagtggcagcatggtataaaaaatgaccagagactgtatttaggtctgccagaaagtatattggttaaaaagtgagctttgttgccagtggcaacacggtataaaaaatgaccagagactgtatttgggtctgccagaaaatgtattggttaaaaaatgagctttgctgccagtggcagcatggtataaaaaataaccagtgagtgtatttgggtctgccagaaggcttgttggttaaaaaatgagctttactgcccgagactgcataatacaaaacgaccacttattgaaaacctaatctttggattaagaattttgcattgtgacttctggcttacctgactaattatcgccctcactaaatacgttttattcgatggtgaggggttggtgatgagtgagaaagaacaggtatcagtgtccagaaaagcgggtgctttacgttcggcgctgaacatagcgttgaatactgattatgcaataaatttgtggcaggggcgtcctccggaagaagagggggaaaaggaggggaagaaaaaagagcgtcgtcagagtcttattttcagtatgccagccttcattcaaaaagcaggtcgtattaatgccgattcatttaatgacaatccgtatgctgatcagaagatgcttgagcttgagacacttttgcagtccgcttcggtcaagatgaatgaagagcttgttgcactcaagaagtcaatgtcaatgctaccccctcaggcgactatttctgaggtcaactgtgcttctcctttaaatattggagttttcagtcgtacacctctgggttatcgatgtgtatggcttctggttggctttgaccaactggcaatgcaggcttttcaggccgcgcattatggttttatctcccagcaagagcttcaccgtagccttcgacggggaggccatctaatccgtcagatctatggtgccgctcagaaatatcgtttttttcaggtgaaccgccgcgattttgcattacagaatgctcagtaccatgaggcaatcaggaacgcaggtgaaattgacgaagctgttttgttggggcaaaaacgttcctctttttcacccccagtcagtaaggagagtattgaacttctactggcggcaaatgcaaaagcagacaaagcagatattgtgcaattactgtaagaaccgttagaagaacagattgtggctgacccttctttatttgtcgctgattcgaaacgcatcgatggttaagcccgcagaaaggctggttttctgaaaggagtgttatcatgcgtctggtgttgtgtgaaaaaccttctcagggcagagatattgcgaagtttcttggcgccactcaaagaggcgaaggattcctgaatggtccgggagttacagtcacctgggctcgcggccatctgctggagacagctgaaccggaagtatatggcgaacagtatggtaagccatggcgcaccgatgtgcttcctttattaccacagcagtggaaactggtagtcaaagcggatgcaaaagcccaattcgcggtaattaaccgtctgcttaaacaggtagatgaggtggtaattgccacggatgctgaccgggaaggtgaagtaatcgcccgtgagttgctggattactgcaagtttcaggggcgtgtattccggttgtggatgtcagctctggatgatgccagtatccggtcagcgttagctgatttgtggccgtcttcccgaactgaatcgctttattatgctggcgtgggcaggagcagggctgactggctgatcggtatgaatctgactcgcctgtttacactcctggggcgtgaagcgggtatcggtaacgtactttcagttggccgggtacaaacgccaacgctggcgatagtggtaaagcgtgatcgtgaaattgataacttcgtgtcgaaaccgtacttcgaagttattgccacgatggccgtgaatggcgtgttgtttccatccaaatgggtaccggctgcacagtattgcgatgaagagaagcgttgtatccagtcgggggtagcggcacaggtggttcagttgtgtcggcaaacgccaacggctgcgataatcaattgccagatcgagaggaaaaaacaatcagcgccgctggctttcagcctgagcacactacaacaggcctgctcccgacactgggggatgccagcccagacggtacttgatatcgcccagaagttatatgaaacccacaaactgacgacctatcccagaactgactgtggttatctgccgttatcgatgcgagaagaaatcccacaggtactgtctgctgtggtcggaactgatccggcgctacagccggtggtcgcgagtctggacactcagtttgtgtcacgtatctggaatgataaaaaaattaccgctcatcacggtatcattccgacaaaacatactggtgatctgagcaaactcagtgatgctgagcgcaatgtctatcagctggtcaggttgcactacctggcccagttcctgccccagatggaaattgacgtgactgaggtcacatttaatattggcggtcagcttttccgtacccgtggtaacgttttggtgaaacccggctggaaatctctgtttggcaaaatgtccgaagatgatgaggataatactggtgaaaccacactgcccgccatgcaggcgggccaggtctgccaggtgcagggcgctgagcagaaggtactgcagacaaaaccgcctgctccgtacaacgatggaactcttattgccgcgatgaccaatgcggcggcgttcgttactgacgccgcgctgaaaaaggtgctcaaagagaatgcggggataggaactgaagcaacacgggccgggataatcgacacgctgttgaagcgtgggtttctggtgcgtgagaaaaagacgcttaagtcaacacctcttggacgtaacctggtggatgtgttgccaggaacgttaacgaatcccggacttacggcactgtgggaacagatgctggatgaggtagctgcaggcagggtgagcctggatgactttatggcaaagcaaagtcagtgggtcagtcagctggtcgctcaggggagatcacagccactgactatgcaggcgccaccttcaccaccctgtcctgtatgtggcggcaagacgttgcagcgcaatggaaagagtggcttgttctggggctgcctgaaatatccggagtgcaaaggtatcgtgaacaatggtaacaagggccccagaggacgcagacgaaaaccttcgccagcctagaatactaacgggttgttttctttcgctgaattctggtagccttatatcgctttgataagagcagcacccatggctgtggaacggttcgaaagctttgcatgcctttcgcaactccagtcaggagaacgatctttactcgaaggatccgtcctcaaagcgcaatcactccgtgaaaaccgcgctgagccattgaccggcttcggagatttgattttacctcatgttctggtgcaacagtttggttgagaaatggccttcgcgttagcgagggccatttttttatggcgagacaaaaaatatttaacgggttgacagggttaactaatgttctaaaaatggtcgcgaaccttatgtcgcttagcgaccaccaatgttccagtgatctgagaggagcgccttcgggtgatcacaacaccaatgttccggcaatctgagagggacgccttcgggtgattgcacaccaatgtcatcgtagcctgagaggtgacgccttcgggtggtacagccctttaatctttggaaacggctgtcgcagcattttgcgatgaagatattttaaacttattgatcatcagcgttttgccagcgttgatatccctgcgggaatccatcatcccgccagggtagatgttttctccgcaacgatttcattccatggagaaacatcatgtctaaagaaactaactactttaatctgaatatcaacggtctgggctatatcacgaatgtacgtcaggttgtcaacggtaacagtaagtttacctgttgtacgctgaatgcccttagtggtccgacagataatgcagactacacccgctttgatgtcacagtcgcaggcaaagacgcaacgagtttaattaaccgctgccagaagtcctgtgatgaggacaaaaaagtaatgatcggttttgttctcagtgggatcaaatccgatatttttacccttgcaaaaggtgatcatgccggtgaaaaccgtgtcagcctgaagactcgcctcatccgggttgactggataaaaattgacggtgcaattgtctataaggcagaaaaaccggattccactcctccggcccagagccagcccgcgcagaagcagtacgcggaagattcgttctgagttctccttaacccttcctgatggaaacacactttccgtcaggaaggtgtgttcctgacttaatgtaaaaggaacaatcaatgttaacttcaccatcatcttctactggtttactggcagcaaaatttgccgggttatccttacctttacaggtccttcgcagtggtgccggatattacatcggcacgcaaaatgaagaagggccggtatcccgtgaatctgttgagtacttttccactcagtctcaggcagaacatgcgctcaaacagggcacatggtcacagcgtgaacaggcttaaggagagatactcatggcttctaaaggtgtaaacaaagttattctggtgggaaatctgggacaggatcctgaggtgcgttatatgccaaatggcggtgccgtggtaaacctcagtctggcaacctcagatacctggacagataaacagaccggtgacaaaaaagagcgcactgaatggcacagggtggttctttacggcaagctggccgaaattgccagtgagtatctgcgtaagggctcccaggtatacatcgaaggtgcattacgcacccgcaaatggacggatcagtctggcgttgaaaagtacactacagaagtggtcgtcagccagtcaggtacgatgcagatgttgggcggacgaaatagtgcgggaagtgggcagcaacagggcggctggggtcagcctcagcaaccagcagcgccttctcacagcgggatgccacctcaacagcatcctgcaaatgagccgccaatggacttcgacgatgatatcccgttcgcgccgttcgggcacagtgtggccagacatgcgctttatgtgctgtcctgaaaattgtcgctgaataatgccttcctgtggaaggcattatgttttgaacatatgaaggatacggaatggataacgaaaagggtcataaccggcccgggcacgatggcctgtttaagctttttctgcgtgagccggacactgcgagggatttcctggcagttcatcttcccgcagatatccgcgcgcaggttcgtctcgatacgctgaagcttgaaccgggtagttttgtggatcagaagcttcgcgaactgcactcggatgtactgtattcggtggaaaccgcagaaggtcacgccgggtacatatactgtcttgtggaacaccagtcgaccgcagaccggatgatggcctggcggatgatgcgttactcgatggcagtgatggatgcccacctgaaaaagggtaacgggacactgccggtggtggtgccgttactgttttatcagggaatggtgcggccttacccatacagtacagactggatgaactgtttcgatgtaccggcgctggcgcgagaggtttactcccgaccgtggcccctggtggatgtcagcgtcatggaggactgcgacctgcagtctcaccgtcgtatggcattactggagctggttcagcgggatatccggcatcgcgacgctgcatcgctgctgcgtgatgttgtacagctgatttgactagccggaaatacccgggcgcaggtggaagccgtcctgtgttatattatctacaatggcatgacaagcgagagtatcacgccgtttttatacgaactggccggtgagatcccggagtataaggagttgatcatgggcacaattgcacagcaactgaaagaagaaggtatccagcagggtattcagcagagtattcagcaggagcgtcaggccagccttgagcgtgagcagaagacgttactggaaactgcgtatgccttgcttgacaatggtgtcagcctggaagtggtgattaaatccacaggtctgaaccgcgagacgctggaacaaccgcgtcattaacatcgagggttatcgaccttctttacattgagtaaattcatgtatgcagaatgccagcaatgatgctggctttttttttcatttttgcataaagagttgtttattgagcgctaagccaaatctccgcacgattgccgtaattacggtcatccacgggatttttcatgaacacacaagcgcttttctgcctgagcctgccgctggtgattgccgggtgtgcacagcagacctccacccaaaccgctcgcgacagcgcatttgcacagagtcagcagccttccgtcttctctgatatttaccagcgatcaccggaggtgactcgcagcgggcgttacacgctggtcagtattaaaagtgcggatgcgcagcgggaaccgctcaaccagctcatcgatattactatgccagggcaactggttaactcagtcggtgacggatttcgctacctgctgtttcagtctggttattccctgtgcggacattatggtgctgacttttctgagctgctgaaccggccgttaccggccgttcagcgcaaaattgggccgatgcgactcagtgaggcactgcaggtggtcgccggtcctgcctggcgaatgtccgtggatgaagtcaaccgggaggtctgtttcgtattgcgtgatgcatatcgggtacaggctaaaactaaagcactgacatctgtcacacccgccgtgaccggcgccgcaagaacctcctccccggaaaccacccgcaatccttataccggcgttctgccggggaataaagctgaacccgtgatcgccggccagcacctggcggcgaagaaaggtactgaactgaaaccggtcagtcagtcacttcctgtccctgccctgagacctggtgggacaccggtaacgtcaggagtgtcctctgccccccccgtgaaacaagtctcttctccggctccgcgcaatccgttcacaggaaaaaacctgaccgggaccaccctgtcggcgtctcattcaccggcgcctgtgggaaagaaggctcaggctaaaacaccgtctccctcaaccgttaaggctgtaaatccggcgacggctacggtactggccacgacaacaaaaccgttaaccggtacgcctgtagctgcagtggccagtggccctgagtggaaggcggttgtcggcagcacgctcaaagagtccctgactgactgggccggaagagctgactgtccggggggaggacactgggtggttatctggcagacccctacggattaccgcattgacgcaccgttggtatttaaaggcaactttgagacggcgctggttcaggtgtttgacctttataagaaagctgacaagcccttatttgctgaagcttcccgcctgcagtgcctggtttcagttgcggataaaccggctgaccggtcgtagctatgggctggttcattgtcgctctgggcacagtatttctgcttgtcgtcggacatgtccagaccactcagcgaagcgaggttgtcaaagcgcagcagtcggggagttcgtatctgttggcccggcaaatgttattgctggctgcgggaattaatgactggcgctaccgacataccctgacggacggaacggtcgccttgtcagaactggccctgccggtggctcctgacagccgtatccgacatgtcattgtggctaaccggctgtgggtctggatgcctgaagtcccgggtctggtggatgcgctgcgtgaacagtcaggtgggtcggcattaactggcacggtgacgcaggggcaactggtctggttatccggtatcggtaatggaccattcagtgcccgcgtggtaccggacgactgacctgctgccagcgcatcgggtgaaaaaattaccctgacgccgcaaagcgcagtgattcgctctccaacttccggcagagtcagtccgtcccgtgccagcgttatctgacagtcagggaagttttcctgagggataccccgtgacactgtcgggacgggtttgagattgacccagggtttatccgtccagaccagcgctccctgtgaggatcgcatctgctcactgacatgaccgcgggcaatatcaccgctggcttgcgcactgcgcgacatcctgtccatttcctgaaaagtacaggccggcagcgaaagtgcggcgacgatggctgtagctgcaatacggagcctgactttgtaatattttcttatcattaaagattttcctaattgaggtagaccacatccccgttctgaatacctgccggtaaaggcaaccccgaagccacaccggataacaatggaagaattccgttggatcaactgggcggcgctgttgattcggcacgcgcgaccgccacaccagtggtactgagtggcctgcgctggcaggacaaactgtccggtctgctggacatgatttcggccaggacaggcctcaccccgcgtatggataacggggcaattctgttttcactcctggagacgcgtactttccagttcacatttctgaataccaatattaccagtaatgccagtgttacctcgggttcaacaagcagtatgggaaccagtggtggcagtacaaacagttcggtgtcaggggattcaagctcttcgcagcagacgacggtcgaccagagccgtaatgtctatgacgatatgaaaaagacgctggaaaccatggtgactccgcaaaagggacgtttctggctgtcggccagtaccggcactctgacggtaacggataccccttctgtactcaacagtatcgcggcgtatgttgagcagcagaaccgtcagatgaaccgccaggtcaggctcaacgttcaggtactgagtgtcagtacttcacgtaaggaacaactgggactggactggaatatcgtttacaagtccctgcgctcagccggtgcttcactcaataatgtaagtggtgatatcaccaacgcaacgtcggcgtcggtatctattctggattcagcaaccggaagtgcggctaaatttgccggctccagtctgctgattaaagctctgtcagagcagggcgatgtcagtgtggtcacctcgcagggtagcgtgaccacgaaccttacacctgtacctattcagatggccgaccagacggtctacgtggcacagagttcaactactaccacaaccgatgtgggtgcccacatccctgacgccgggtatgatgactaccggcttcaacatgacgttactgccactgattcaggatggtggtgacgtgcaactgcaggtggcattcaacctgtctgacccaccgactattcgtaacttcacgtccaaagacggcaactcgtacatcgagatgccgtacaccaaactccgctcgctcagccagaaaactaaccttcgcgcagggcaggcactggtgctgacaggttttgatcagagtaatacccggatgaccaaaaacggcacctttaccccgggtaatttcctgctgggtggcggtcgggacggcgatgattctcgtagtacgctggtcattattatcaccccggagctgatggggaacggtggctgatatggcagatattccgttatccggcaagccccgtacgcaggttctgcgctggcagcgccagaactgggtagcggggcttcgctgggaagaaaagcaaaagtcggtacgtcgagcccctgtacaacgtcggggtgttctgaacgttgtgttgacggtgaagcagggcaagagccggttgaccgcgttggggcaaattgaggccggctggcgtcaccagaagctgtattccctggcggcgctgttcagccagcagtgtacacccaatggctatggggtataccagcttgatgatggcagacaggtctttctggccacggtgaaggggatgccatctccgatggcagatgtgatcggaactccagatcaaatcatccgggcgagagagctctttctgtccttcaaccctgctcctgaggacggatggacgataccttcatcaccggaattccccttgtcctggaacactttggtcggtcaggtatcttcggcacagctccggtttgccagagtggcgggcgtgtctaatcctttgcggccatacggggcgggagtgctgtcagtggctgccctgcttggtggtgcagtctggtggagcaggttacccgaacctccggtcgcgcctgtcgtgcaggagttaccggcaccggtgcaggacgtgtttaaaaaaacacctgaacctgtttaccttccacatccctgggcagatatgcctgtggccagacactttctgaaccgctgtcagcgctggcgcgccgcagttcctgtaagtcttgaccgttggcgtctcgaacggattcgttgcagtgctgaggggctggagacggtgtaccagcggcagcccggtgggacggcggcaggctttgcggagcgggtgaagcaggtttttaagcgtacaccagtattcaaccttgtttcaggtggcaacgaaggtgtggtgtttattccatgggcgaaattcacattacaggatgagactgcgccggatgcggggacccagttgatgcaggcggtgtcgtggtttcagtcacgccaggtcagtttttctctgtccgaagtgaaaactcctcccgcgatgcccggtgatggtgccggcaacgatgcgccccagccgatacaggactggcatgaatacacgttcagtatcactgataaacacatgcctgagtggattttacagggactcgatatgcagggggtacggctgagttctgtgggttacaccctgagtcctcagggacagtttacttatcagattgaggggcatctttatgcttatgccaaaaaatagtgttttcatcagtggtgttctcctgatggcgttcagcgcaggggcattttcgcagcccacactcgcagttcctccttccgcagaggtgatttctgcaatgcctgccagtgaacccgctacggaagcagcggcatcgatatcctctgcagacttatcagatacagtccccattttccccggtaacagcgtgacggccggacagctggaggcgctgcaggggaaaaacctgctcctggaggcaaaggttcaggcagcccgactgctaaaagagctgacttctgcacaaactccgggggatgttggcaatgtgcccacgaccagtccgttcgttatgggaatgccggcagagatgaatgcgactcctgttcacaccccccctgcaactggacgaattacggttctggaagtgagtggccgtggtaacgccctgcaggccacgctgtcatttccggatggccgacaaagcctggtacagacgggaagtgtgattccggggacatcactgaaggtgaaggcaataacgctctcatccgtcacgctcagtgacggtcagcaactgacgttttagggacgaattatgtctgaacacaacgatgcggttctgctttaccacaacccggacaccacgatcctcgagctgctggttgacagccagcggcgtaccgacgtggcggtgcagcagaaggtaatgtctctgatggaggaaaaccccggtgtcacaatgaggctggtaacccgttcagagttgctcaggtacagtgaaatggctcgccagcagtcagagaagggagaaaaaggacttcgccttgaggacatcaaaaaagaggtcagcagccgtcagggcgatgttctcaactattttatggtcgcgaaagatatcggcgcgtctgatattcacggtaccacccggccaggactgacgcgcatcgagatgcgtgtgcacggtgaactggagaccgtttcggaactggctgaagaagacggaaaagcacaggcggccactatcatcctttccatgtgtgatgtgaccgaaccccagttctacgccggccgaaaacaggatggtcgtgtggctgcaaagtttctgcgaaaggtggggttatttggcgcccgttacagccacaccccgacagcagatggccttcactttgtgatgcgcgtgatcccggatgatggtgatgtggttcccacgctcgaaaaactcggttttctgccgaaacaaatccgcctgataaagcgcactttgcgcctgccagaagggatgattattttgtccggcccgaccggagccgggaaatccaccaccctgcgtgcctgcagcgacctctatctgaagcgtacccggtataaaaagcgcctactgacggttgaagatccgccggagggacgcatcgttggggcaatacagacttctattatctgtgacaaagccgatgaggcggaagtcaggctggcctggcagcgggtgctgacctcagcgttacgtctcgatccggatgccattttacctggtgaacttcgtgaccttatctccattctggccgggatttttgccgctcagaccggccatctggtgctgagtaccctgcattcaaactcggccttttccatccctgagcgaatgataacgatgggtgcaaatgccggactggtggcagatgcccagttgttggtcgggcttatcagccagcgtctggttcaggtgctgtgtcccgagtgccgtattccctggtcggttaaaaaagaacatctcaccaccgaagaacgtgaatatctggaaaagtactgttcagtggagggggtttgtcagcccgaaaatcttcatttcagaaatgaggaggggtgcccgacctgccggaaggcggtcattatcggtggcaaacaggtggcaacagtcggtaagggggtggccggacgcagtgtggtggcggaggtggttcgcacggattctacgcttttcaggctgttattacagcagggtaaggaagctgcaaaagcttactggatccgtgaaatgggggggattacccgtcgcattcatctgcttcacaaactgaatgacgggctggttgacccactggatgccgatttgattattcctcttgatgaggatgaggtgatgcaggtggtaagtgatcaggttgcatcgtcgagtgacattgatacgtcgctgattgaacgccttgccatggtaattgcagccagcgtcagagaggggatgaagcagggtgttgaggaagccattaaagaaggcgttgctgccgggatggctgcgctgaaggaggttgcatgagtcctttataccgtcttcgccgggcgctggcgcgacgtttttttacgtccggataccgtctgcgtttttaccgcatgctgtcgttgcagatgagaaatggcgtgaagttgttagaggcgctggagcaaatcagcaatatgtataccgattttgggcagcggactcatggtttcggttttctggtggacgactgccgggcggcactcactgacaacagcggggataactcccttgagcatgctcttgcaaactgggttccggcggaggaggcggcgctcatcagcgcgggtatgttcagtggtcggttacctgaggcgctcgcagaggcggaaatcctgattgactgccggcggcgtatccgacaggcgatcatgaggatggccgtttatcccctaggttgcattgcgatgctcggtggcacgctgggtgttattcagacgcagcttattccaacgctggccgggatgtcagatccgcagacatggaccggagtgctgggaagccttaacggcctgctgattttttttactgagcatggcgtggtgatgggggccgggctggcactgttggtcgcatggaccaggtggtccctgtcgaactggatacgtccggaccgtctgcgtcgtcttgcggacagacatgtaccctgggcggtttacagtgatattcagggcgcgatttttctcatcaatatgggggctctgctgtgcgctggggtcagaaccctgactgcgctgcaggttatccaccgctttgcttctccctggctcgttgtacgtctgaacgcagtgatggaggaagtggaggagggggcctcttttggtatggcgctgcgtgaatgtggttatgccttcccctcaaaagaagccgtgaactatctctctatggtcagtggggacggggccgctcagatgattgcgcgctttgggcaggaatggctcgaggaaactgtgaagcgagttaaccgacggggaatagccgtgatgctgttctcaatggtgatgttatttgcgcttattggcgttgtggtcgtggcggtgattgaggcgatttcgatgaccgagagtatggggcagtactgatgttaagcaattcaatgaaaaatgaaacagagggaaagatgatgaatgaggtatcaacattaaatccatgcaacaggcctgaccggggaatgtcggcagatgccggtgccactgcactgtttattctggtgatcattggggtgatagccgcggcggtctggtcgatgtggggtaaaaaggatgcgggtacggagctgacaaactatcagaccctggccacgaataccattggcatgatgaaaggcgttgacggttatgcttttaccagtggcgctaaaatgaccgacacgttaattcaggccggggcggcaaaagggatgacggtcagtggagaccctgcttccggttccgcgacactgtggaactcatggggtggccagattgtggtggcgccggatacagcggggggaaccggatttaataatgggttcaccattaccacaaacaaagttccgcaatctgcctgcgtatccatttcaacaggtatgagccgttcaggcggcacgtccggtattaaaataaacggcaataaccacaccgatgcgaaagtaacggcagaaatcgcgagcagtgaatgcactgcagataatggccggaccggtaccaatacgctggtttttaactacaacggctgaggaggcgggatgtgtggatatttttcccgactggctttattcatgacgctgtgcagtgtgccgctgtgggtacaggcattctgctttgatgccgctgcggcgaaataccatgtctccccgctgctgattaagtccatggccattggtgaaagtaatcttgatccgcatgcaacaaatgataaccgggacaaaaaaacggggaaaatcaaaagcacggattatggactgatgatggtgaattctacgcatattccccgtcttgtctcgatgggggtcatcagggacaaaaatgatttgctgaacaaaccctgcctgaatgtgcagattggaacgtggatccttgcgaaacattttcaggtctgtggggtgagctggaactgcctgggctcttataacgcaggtttccggcctgaccggcatgaaacacgggagcgttatgcaaaccggatctggaaaatttatcagcggcaaacgggggctcaatgacagtctctcttatcggtaccatttttcctcctgtgtatgccatacctgcttttatcgggtgcgccattttcggggcggtacttttaaggccggtacgtctttatctggccgcagcggaggtggatatctcacgccattgtgccgtcgtggtgggtatctggctgtttgcggtaacgggtttgctgatacttatggcacctcaggtctggatgacacgtatcggaatgctgtttatgtgcagttttttgctgcaactgggagtgatggatgcgaccagcggttggttgccccgaccgtttaccgcagcctgtttatgtagcggattattgttctgtctcgcttttcatcgggagccggaacttcgctttatggaaactgcggcgatggcggtggtgatggggtctatttgtcacggtgttaaccgacggcgacctcagcttggcgtgggagatgtctggctggtttgtgccctggtaggctggatgggggtaacggatgcactgcaggcggcgttttttgggctgagtggttttatgttgtggcagtggatagtccatcgggactttctgcgttgtggggttctgggcccctggctgtgtgcagggtgcataccagtcattgtggataggttgtaccagcctgagtggatactgagatgaaaaaacaaaaacatgatggcggctttgtggcgatgagcgtgggagccgggttactcattgttctggtgatggcctcgttggctgccagatatatgggagattatctgaaatcccgtgagtggcaggttgtggccatgcaaaccaatcgtttcactcaggcagtctcatcctatgttggaaagttttatccgacggtgctggcatcagcgaccacaactacacctgcagtggtaacaactcaaatgctgaagaatacaggtttgctgccggcgagctttagtgagaccaacagttatggccagcagtatcaggcgatgatagtccggaatcagcaaaatcaggagttgcttcagggcatggtggtcagccgcggtggtcatgctatgccttttacagcgctaagccagatctcgaaagacattaccgccggcttcggaggatacgttgaagacgggcaaacggcggtgggagcgatgcgcagctggcgaattccgctgtcctcctacgggaccagcaccggaagaggtcatctggccgtcatgttgagcacggatgacctgtcaggggcgcgtgaagacggggacaggctgtatcgttttcaggtcaatggtcgtccggatttgaacaagatgcacacagctattgatatgggaggaaataacctgaatagcgtcggcactgttacggccagtaatgtggctggccagaatgggaattttggcgtaagtctggtcagtaatggtccgatcactgcggggggagatattcgaagcacagggggatggattgtaacccgcagtggtaaaggttggatggatgagacccatggtggtggtttgtatatgtcagataacgactggttacggatcctgaataacaaggggttttataccggtggtgaaattcgcggtgggaagattcgctcggatggggacgtatcggcaggcggtattttaacgctggataagattaatgttgccagcactgcttgtcctgtaaatggtgcaataagtcgtgatacagcaggtgccacactttcgtgccaatccggtatttggagttcttatcggctgaactttaatattcagacatttaacgtcggtaaaaatgtaagaaatcagtatattggagtgcatgcctactgcgcatggacatatctcaatggttcacctctgggcgggtttcaggagatacactcgaacggttccaacggctggtatatctctaactacagatgggggaactacgaatccggaggtactatttcggtaacctgtttgaacttacctggcgccggattatgaattaaagccctgcacccggcagattcaggcatgttacggaaacagtcgatcctgtttgaaaacctccgtaaggggtattcgtgacataccaagcgttccctacattgtagaccctctggcgcccccctagaggagcagaaaatagatgtgtccaactgcaataagcatgaatgcctatgtactgcgcattcacattctgccctatgtcgtagagctgtgtagtgaatctgttttgacccgacacccagataccggattggcacgtatgtccttacgaggattgagggtattagagtttttcgttacggtggagaaaaacctcaattcttctcgcaaaggtatctgcaatgtctcgcccacaacgcataaaaaaaatgtctctgtcgaaagcccttgataaatactacgccactgtgtctgtgcataaacgggggcatcagcaggaattctatcgtgttagggtcattcagcgacatcctttggcagagaagatgatggatgaaatcacgacagtggatattgcgtcttaccgcgatgatcggttgtctcaggtgaatacgcgtaccggccggtgtatttcaggaaacacagtccggctcgaactcgctttactgtcatcactgtataatctggccagcgtagagtggggaacatgcagaactaaccccgttgaaatggttcgtaagccaaaaatatcaggaggacgagatcgacgtttaacatcacaagaggaacggcgcttatcccgctacttccaggaacagaatccagcgcttcacgccatatttcacctcgccattgaaacagcaatgagacaaggagagatcttgtcacttcgatgggaacatatcgacctgcagcatggcgttgcccatttgccaatgacaaaaaacggcagttcgcgagatgttcccttatcccgcaaagcgcgtcatttgctacagggaatgacggtcgcacttagcggtaatgtttttcactattcatcatctggttttaaaagcgcctggagggtggctctgcagcgcctgaatatcgtcgatctccattttcacgatctgcgtcatgaagcaattagccgactgtttgaactgggaacactcaacgttatggaagtggcggctatttccggccaccgttccctgaatatgctcaaacgttatacccatctcagagcataccagcttgtcagtaaacttgacgctcgccgaagacaaacacaaaagattgctccctattttgtcccttatcctgcctgtattgaatccgttaatgaaggatcagatggctgttgtggttttcgtgttcacctacccgattttgacaatctttcagtgtcagcggcatcgagggagagtgcgctggaggctgcaggtgttctgttgctacgaacgctggctaaagcggctcagcggggagagcgtgtgcctcgccccggggatttgccggaaggcaagcatgagcgggtaatgatccatcctcttttgagtgctgcctgataaatttgccgttacggatagtcatttacgtgatttattctcgtcgttaagagggtacgctgctgccgttcattttctgcaaaaaaggacagaggggtggagtacgctttgtttgtgatgttctgtctggcgctgtattgcccgtgttttacgttaattgcgctgttcacgccctggaaagggtttgctgtattcagtgtaacgtatcgtcgccgtcaatactgggctgtacatcttgccttgcttgatcgggtgggggcgatgaaccgccgccaggcccgacgctatcaccaggcatttgttcaggcactggagacagccctcgtggcgcggccggtgcgtcccgtttttttccgttcacatcttatgcggccagctcaggtagcgcttacctgtcaggttctttcacacaggacgggatatcgctgtcggatcgctcccattacgcttccgcgctgggaacgtgttgctatttttgcgcaaatgctgctacaggagtggcggcttattcaattgccttctgaggaggggataatggtagtcattcatcggttggcggaataaatatttttttagaattatatttttcagtcgatttcacgtcgacatggttttaatcttcttcatacattagaacaaatcgaccgaaatattccattatacctgatgaataaatgagattaatctttctattacattggaacgcagaactgaaaaaatgaaatgagttgaattttactcttttgtatccaggaaaatatttaaggttgtcagtatgaatgcaacttataacgcgctaattgcattaatgcgatctggtgaaataccacttgaaacgggggcatcagtatctgcacccagtgcacagttttcagtaagaatacggccggaaactcgggtatttctggacaggtgcgcagagcatctgggtatatcccgggccgctatgtttggtatgtgtattgatggcattgtagcagaggcgagagagagtatagcggacagaacgtccacgctttatgagcgattctgtctgctgttggatgctcatggattgaatgttatcgaacaggcacagctactggcttcctggggaataagggccagtgtattagcgagtcaggataggacgcttgatctcctgaacaaacctttgctgcagcaattgtcgacatggtttgatgtggatgttaactggctgctgggaaactcttcctatccggtagatatggctgacggccagcgcgactgggctgtgcagaccccctctctgttatgccgtctgcagtcaattcagtcagtggatccggttgagttaattttcttctggcagcaggggcgtaaacctcaaagtgtggggttgtgtctgcgctatcgcccccttatttcgggtgagccgatcgggctcctcagggtatatcaggcactagactggcaggatgagcaggttcagcaggcatataatcaattgcggcgtataaccagtatcactcttggcgggtatacaaaagataaagtagaaaaatatcctcctatccgattacgttatttcactttctcagcgcgacaaatgcaggcattggataatggggcggttattcctgctatgatattcgataaacctaagggtgaatttccaagcatttcctgattaatcaatttatgaaataaaaacgggtgtatttctctgttcttatcgctttatcaggaactgcgaatgcggcaacaacttataaggatggcgtcaactggcatgttgctgaagaactgacgtactgggtgaactaaccatgacagggggttaggcttaaaacttcgccttcacaggaactggtcgcttgcaggcatggcttaatgaactggcaggcgcctatcgcagggttgaagtgatgacttacagggagatcatcactgcgttgccggcattgcccgctgacggggaatggtggcgacgcagtctgcggggtgtggggcggcaaagagccccgtcaacgctttatctccatatcgcacatatcttcaagaggctgccagtttgtgttcctgacgctaatctggatcccttattttcacttttgagttttgatttgtctgtcgtatccgctgaactgtttttgcatagtcatggcgaaaaccgttttccggaggacttataccatgacgacaacgacggcatcttctgtcgatattccgtcagataatgatttacctttatccgctcacctcactgaacctgccgaaccggctattgatacgtctgatatcactgttacaccagatacttcagcacagtcagctgcataccgactggggggaaagaggagtcgtctgtggcatccttcttcagaccgccgttccctcatatttaaagtgtcatccgttctggtgtactgcttattactgggtgctgtcttattcctctggctgacagtacgtcagcagcagatacagcttaccacccttgatgcggcgttccgcagcggacagctgcagacacttcccgatcgtatgcaggccatagaagacaggcagcaacaattcgttccgaaactgcagggagaaaaatggcagctcaggctgagtgagcaggagctgcggctcaccgcgtttgagcagcaactttcttcgctggttacagaggttaaagagactcaggcggcgactgccagggctgttgcccgagaggatgaaacgggcatgaagctcgacgctgttcataaagcgctgactgagcagacttcgcgtatagataccctcgcgtcttggaaagacacgtggagcaaacgcactgtggcgactgccacgaaggcgaccccgtctcccggaggtggacagtctgccgcaaaaaagtcgtcaaaaccacgggtcattaagccgcctttcacattggtgagtattgaacgcaggggagggcaggcttacgccgttattctgccggcggggaacagtggctggacacagctgcgcatggtaagcccaggagagagtctgtcaggctgggtgctggtgaacatcagcggtaaccaggctgagtttcaggttaacgggcaggtacaacgtttaacgctctgaatcagggagaaatattggatgaaaccgatgaaatcaacgttaaattgcctccggcagtggactgcgtcagtcatgctggctgttatcgtaagtctgcctgctcttgcatcagtgagtacgggtcgcagtgtaagcgcaccccagcagcaaaatacgactacagaaggaaggacgcaaacgtcaggaacggcatggggactcagcgaaaaagaatggcagcagtatcaacaggtacttaaaggtcccagagcatttcagtcacctggcattgacccgttgatggcactggggctggaggccggttcggcaagcgaacgccggcgttttgctgaaatgtgggtgaaggaagagtatgcccggggtgaaaaggagctggcctttcagcgggaagtggatgctgcctggaaacgcctttatcccaatactctctccgtaaacatgggcaatgccagcggtattgcccatgatacacagggaagactggcgttatttgtgaagcgcaactgtgtaccgtgcgatgccagagtaagtgcggttctggcagataaccgtccggttgatatttacctggtcgacagtggcggcagtgatgacaccattcgccagtgggcgcttgcacatcatattccggtcgataaagttcgtagccggcagataaccctcaaccacgataacggcaactggctgaagtatggtcagggatatatgccggttatgcttcagcagggagtctccggatggcaaatcgcagcattctgacagcagccagatacagcgtccctgttctgatccttcttatcgggggtgttggtagtgcagctgcggtagaaaagggacgcggtctgcaaacaattcccccgggttaccaccttgtggcaactgaagtcggcgtacccgctgaagccctgtattcagtttctcttgcagaaacatcccgaaaactaccacatggagagcgaccgtggccgtggacactcaatgttgccgggaaagggtatcggtataactcccgccaggaagcgtatgacgcaatgttgtcgttcatgcgtcgctatccgttaaagcggattgatgttgggatcgcgcaggttaacctgggctggaatggaacttatttcagcagttactacgaagcgctggatccatataccaaccttcgggttgccgcccgtattcttaaatcctgttatgacaacaatccgggaagctggatacaggccgcggggtgttatcaccatcctgcaggtggaaaaccagcacgaatctataagtccatcgtgaaacgcaagctggcaacactggatttaaacgcgccagtaacgtactccgaacttcagatcgcacagatatcgccatcacagcgccatttctcacactacaaccgtgaattgcaatgggttgaacccagggagtcccgtcagtgaaactttattctgtctgtttttttttcaggacattaatggtcagtattttgctgacaacatcatcgatggcagcactcaatgtgattgctgatcttggcggagaaccaacagcgccgctttttgatgccatcaataataagaacaacgagttcactccgccgaggtcactgaacgccacgggcgcgtctgtaaccgcagcccctgcggatgtaagtgatatgctgcccgtaaccacaccggaaatgcgtgcagggaaagtggaagcccgtgagttaaatctgaacgggatgacaccggtctttcttgttggggatgattcgctttcacgcgagtggttgacgatgcggcgtgatgagcttaagcgacttcatgctacaggtctggtggtgaatgtcagcgataaggacgcgttgtcggaacttcagcaaatcatacctgatgtcattctgctaccggcatcggcaagcgaaatagcgcgtcgtttgcatctcaaccactacccggtgttgattaccgccaccggtctggcccagtagggtgctctcatgatcactgccattcttcttttacttttctgtcttctcattcctgccatatggcgtaagaaaatgccgtccgcacgcgaccgccggcaccggcgctaccgacagaacgcggagcgtgtgctgtgccgtctgacagcgcttgattcagacggggcccgtctaaagtatcttcgaaaaattaacccgtatgtgtttgaagagctgctgttgttggcgtttgagaggcagggactcctggttgtgagaaaccagacctacagtagcgatggcggacttgacgggcaggtttttattgacggaaagcgctggttaattcaggcaaaacgctacagacggactatttctccgcagcatatacgtgagttcggagagctgattacccgggagcaatgttgtggattttttattcatacagggcggacgggtagtaagagcgttaattacctgcagtgctggcgaacaatacaactgatcagcgggcagcgactacttgatttgctggcggggcgccagtgctggtaccaccggccagtaacaaagtcagttgccgggcagccggttgttacataacagtgtgaaaggaggagctatgagtaaccgttatgtcatggaggcgttattgaggccagcagtagaactctattcagctgcggctggcggggctgccacttttgttctggttgtcgcaccatggtcgatggcgttagcaccacaggtcagttatgtgactgcagccggttttgccattttcacaacaatcagaactcgtcagggtttgcgcatcttgcgctatcgacgcaatatccgtcggttaccccggtatcagatgtccagtgaatccataccggtaagccgacattttttgtttctggggaaaggctttatgtgggagcaaaagcatacccaacgtttgcttgagacgaaacggccggaagttgctccctttctgaaaccgtcagttttttactccctggctcgtcagtttgaacgacggtatgagtatacattccctgggttatgtagcctgacaagacgagattcattttttaatccggtacgcccattaccccctgttggtggtaattcggcgatacatggtgtcgagatggaggaagataatgttttgatgagtcttaccgagcgcgttggacatcttcttgtattaggaacgacacgagttggtaagatccgtctggcagaactgttaattacgcaggatattcgcagaggaaatgtcactatcgtttttgaccccaaaggtgatgctgatctgttgaaacgaatgtgggctgagacgaggcgagctgggcgtagcgacgagttttatatctttcatcttggctggccagatatcagtgcccgttataatgcagtcggccgttttggacgcgtatctgaagtggcctcacgtgttgccgggcagcttgggggagaaggaaataacgctgcgtttaaagagtttgcatggcgctttgtcaatatcatcgctcgtgctcttgtcgttcttggtttgcgacctgattattcgcttatcctccggtacgtaacaaatattgcagagctttatgagacctatgccgagaagttactgactcaacaggctccggagttgtggctgatggttcaaaaccagatggggatcctgactgaggatgatttaccacgtacgatgcagggacaggttaatgctattcgggttatggccattgaagtggcattatccagtgagcagggcaaaaaaatatacgatcccgtactggatgggttgcgtagcgctgtacgttatgatcgaacatatttcgataaaatagtcgcttcattgttacctcttctggaaaaactgaccacaggcaaaactgcggcactattatctcctgactacagtgatatgaatgatccgcgcccattaatagactggcaggaaattatacggaaaggcggtgttgtttacgtcggtcttgatgctctttcagattctgaagttgcttctgcggtaggtaacagtatgtttgtcgatctggtttcaacagctggatatatttataagttcggactgtctgatgatatgcccgaagggagtagccagcggttacccatcagtcttcactgtgatgaattcaatgagttaatgggagaagaattcattccgatgataaataaaggcggtggggcaggtattgaagttacagcctatacccagacctggtcagatattgaggccaaaattggtaatgcagctaaagctgcccaggtcacaggcaatttcaataatatgattatgcttcgtgtgagagagaaaacgacagctgagttgctgacaacgcaattacctgaagttgaaatttatacaaaaacactggtttccggtgtgacagatatatccaatccggatcaggggagtgatttcacatccaacgttcaggacagagtaagcagtacacgtgttcctcttttatctcctgcagaagtaatgaatttacctaaagggcaggcttttgcactgctggaaggagggcgattatggaagattcgtatgccgctgccggcatccgttgatgatgaaatgatgccggtaaacctgcagagtattgtcactacaatgcgtaaacactaccgaacgggagacacctggtggtcagggagtgtgctccccggagataatctggtggatgcgctatgagtacagaaaaaaacagctctcaaagttctccaccaccgcgcaagccaccaggtttgctgacccttgttttgtggatctggccagtcaggcttttggcttttctgctggtatcctggatggctggtgtttttattgaatgggcaggaatgttttttttctggtcagatcagggagctttgcattcccagtccgttatgaataaagaacttggctatttatcagcagattttactcaaagccttattttttcttcaccatcagtaactacgatgggctggatttcgtcagcttaccaatgggcatttgtggacagtggattactcacctggattcagaaagaacaaagggagacattaagcagttctgactctgttgttttttttctgggacaagtgcaggcctggttattatcagtgttaagcgattatctgcttgcgctggtttatgtcaccgtcgtttttgccgtcagggtattaattcttgttttatccatcccgttatttgttctggttatcatcgtcgctgttatagacgggttgtgtcgtcgtgacctgagacgttacggggcgggttatgagtcgagttttctgtatcaccatgccaaacggtttgttaaaccggctgtttatctcccttgcttactttacttgtcatggcctgcgtcgatttatccaaatctgttacttctgcccggggcattgttactgggactggcggttactgtagtgacatctacattcaaaaaatatctgtgaccggccagggtcaaccgctgacttattgtcttctctggggggctggcaccagccccccgggaggatataaatttcaaaaaagcataaagagtttcctgctgcatctcctccctgatttcgccactctgttgtgacagacgtactccatgaaacagaggtggtaatgcaaagatgtcaattatcttccagacctttaagggtttttactcgtcctcagtttgttctctctgccagagatggtcagtgcagctgaaaaggatgaactggccctcgctctcaggcagctggaccaggtccagtctgcgcttgaacgcgcgaaaattgtagcggtacaggacaattctgacgggcgtttcttcttcgactatgagcgggcaacacgtgatttgaaaaccatgaagcaggggattgaaacttatctggagccttcccgggcacagccaagagacaaaggttctcttgttggacaatacaggaaggagcagccctgatggctatgaattctgaacaggcaaacgcttttaaagcagggtcaggtatcgaccctacggtacttaataagtttgttctgggttttgttctgagcgttctttttttgtggtttgcctggtcggtattagttgtgtttcgtggatggcgggcaggaaaagtcactgagcaaaatgctctccatttttttatcagtacggccattttggttgtgttttcagtatggatgttcgccagctgaataatttgtttggttaaaaggaaaacatgatgctttcaaagagtaaacatgggttaagagtaccacttccctgtcttttgattctgctgttactggtggcgagcttctcctctcatgcaggattacctacggtcaatattcccggtgggggcggtgggggtgacatgatgcaaacgatcaagcttctgttttctgggtttctcgtcctgatggggctaatcatttgtgctgtcggattttatatggtttccggcgctattctggcgacattctcagaaatacgctccggtaaagcagaatggggtaaatttgttgcgattgtcgttgtcggtatagccattctcgttgtcattgtctggttgtgtactgaagccgcgaagattttgaattgaggtggcctcatgaaaacaatcgagtttttaccggacaggctgaatgccgaaacggtagttttcagagggtttacaacaccagaactgggctatgcagcacttattggtgccgtgtcaggcttaattttgtctctgataatgatgcttgtaacggggatcggctggccaattattccaacctgtactcttatcactccactgatatttatttttatcggtggacgctttctggttcgttttaaacgtaataaacccaatttttacctctacctccggattcaaaaaatactgagccatattggtatcgggagcaaagttctggtccgtcatgatcgacgctggtcattacgcaggagtaagcctgtacgcaaggggggaatatgagccgatttcgccatgctctgaaggatcgcgatcagcatattttgaccctgagattagcgtgtggagttctgcttctcttattgattctggttattacaggatggatgcgggcgcccagtgacctgacaatacataacccgccagatttacgcagcgggagtacgcgtaaatggtgggaggtccctccgagtacggtctacagctttgccttttatatttttcagcaaattaatgcctggccgaaggacggagaaaaagactatccgatgaaaattgcccagttgagtccttatcttacgccatcatgccaggattttttgaataaggatgctgagctacggagtcaaaaaggtgagttgcttgatcgcgttcgcgtcgtttatgagatccccaaacgtggttacaaacctgaaagtgtcatcattgagagcgatgacagttgggaggtcagtctggatttggtagtcgatgaatactatcacacagaacctgtaaaacgggcactggccagataccccctgcatattgtccgctgggaaggtgatccggagcgcaatgcttttggtctggcgcttgattgctataaaggcgtcccacaacgacttgaagctgcagtggtccctgagccagagaaaaaggggatgttttaatggcgatgtttaaagtccttaattttaagtgtaaatggtggccgataattctccttttatggttttcatcagcacaggctgtggagctgatgaaatgggaacggatccctctgcttattccactttctgttaaccatgagcgaattgtctttgtcgaccgcaacgttcgtgtaggttttccggcaatgctcaaaggtaaactgagggttcaaagcagcggtggtacggtttatttacaggccagcgaaccttttgaacagacctgacttcaactgcaggatgttgaatcgggcgagattatattactggatattgctgccaaaaatgacaataaggcgcttgagcctgttcgcctggtttattcgggagaagtgttatcggtgagcgaaaaaggaatggaaacgggttcttcgttgccagtcgcctctttggatacagaagataaaaatcagactgtcagaaaaacgccggtgtacagtgctccattgccagtggtgttgactcgttatgctgcacaaagtctgtatgcccctctacgcactgttgaagctgtacccggaattcatccggtaaatttacgccttccctcgagactcacaactttatatccgtctgagaatgtagttgtttcgccaataggggcatggggtattcaggaactgaatgttgttgcactgaaaatccggaatcgttcttcctccaaagtgatacttgatgcccggactttatcaggatcgtttgtcagtgcgactttccagcatcgttggcttggggcggctggtacgcctgaagatacaacaactctttatcttgtgatcagagggcgccctgagaatgcctttattgctgaacctgcagtattgccggcagtaaaaaaaggggaacagcatgcaaattaaagccaatggcctgatgaaggttttacttccagtattgatcgtggtggtttgttttattggcgttaaagcctgtggtttaaaagatactactgaacctgaacccgctaaaaccactaatgcattgactgagttgagccaggatgatttgaaagcactgggtattgagggggatacgtcagcagacacgctacgtacacttattggagcgttgcgtgatgtccgggcccgccaggctgtgctggatgagcaaaataaggcactcatttctgaaaataataagctcaagggtgagaattcatcggtaggactccagatatcaaatgctgtaaatgccgcaaaacaggaaacgaacgaggctcttgaaaaacagaaaacgttcctactggagaagctcaatgacctgaccggaacactgaaatcccagggacaaaacactgacatggtgtcgacaggttcgtcttcaggaaccgatttcccggttggccttggactggatccagagaatgcatcctctgcaactcagggggaggtgatctggatatctcctcaggatgctaaaaagacagagggtcaaagccagagtgataatgataaattcacctttcccacctcttttctggatgataaccccgtcagtcgtcagcgagctgagtacgatcgcgttgttaaaaacaagcaggaactggacggaaacggtgcagagtccgatacacggcctgtttatacgttgcctgagaactcaatcctggtaggcagtaaggcgatgacggcattaattggtcgtataccaattaatgacaaagtcaccgatccttatccatttaaagtcctgatcggtaaggataacctaactgcaaacggtatcgaattgcccgatgttgagggggctattgtttccgggactgctacaggggatatggtgctttcgtgtgtcagaggaacgatacattcgatcacgtttgttttttccgatggacgtataagaacacttcccagacccgtagcaaacactcagggcaacaataatgacaacgccggagacaggggcagcattggctggatatcagataacaacggaattccctgtatcagtggtgagcgcaaatctaatgcttcaacttatctgccaacggttgcgttactggggatgggaagctccgcaggtgatgcgttaacacaaaatcaatataccactcagaacaatgtgaatggtggggtgacatcagccttaaccggcaatgcggggcaggcggtactggggcagacgctgggagggggatttaaagaagttaccgactgggttaaacaacgttacggacagacgtttgatgtggtgtatgtcccacctggtgcaaatgtcgctattcatattactcgtcaactggccgttgattatgaagaccatggtcgtaaggttcgatatgacttcagcttgcccggaacaggaggccattatggtcttgactgataatcagaaaatcacttcacgtacagtgaaaataactcccgttttattttttatagcgggcatgttcagtgtcgcgcttggtggatgctcatccagcaaagatgaattattgcctccgggagacagttcaatgatggagctctggcaggggaatgctccgacatctcacgccgttgtcaaagggcgggagactctcaggcggagtctttcgtctcaggaaacactggcttcagggcgtattgatgaaagctacagccgtactcaggagaatgagctgagccagattttcccccggttacctaatccggatatggtgatgtacatatttccgcacttggctaatggaaatacgcctgttcctggctacagcactgtctttcctttttatgctcaaacccagtatgcgcttcctggtgaacggacggaggcactgtgatggtcagtttttctttgtttaacaaaaacaggctgaagtcatcttctccccgggagcctgacgagttaccggaaagtgactttgctgttcatggccgtgacccactgaaacgcccgggcatgatgagtcacgctgatgaatcccgtttatacgaaacccgtccgtccattattgattttttgccctgggccgagtacctgagtcgcgagcaatgtctgctgcttgacgatggccagtctgtcggtgcggtatacagtatatcgccagtggcatcagaggggcgcacagctgcccgtctggaagaaataagggattcggttgaagatgcacttcaggacagccttgaagagtttgattctaacccatgggtagtacagttttttgtcaggatgaaactgacttcagtgcctatatgaatcggttagccagttacatcaaaccgcatgctcagaggacggcatttacgaaggcctggctggctgaaacagaacagcatctgcgaaatatcacccggccggaaggtttgttcactgattcacttgtcaccggggttccctggcggggacaaaatcgttccgtcaggatggtggtatatcgatacctgccagcgaattacaaagatgattcgccggttgccgctctcaaccaggtttgtgagcgcctgacttcagccttatctgcagccggcgttctgagtgtccgacagaatggcgagcagatacatcgatggttgttacgtcacttcaatcctgagcccgactggatagacaaagatacgctttaccgggaggctcgttattatgatgatgcacctgattcattgcctcttggcaatgatttcactgagacgttgtggtttaaccctccacgttctgatacccgaaatggtgtgtggtggtttgataatgtggcgcatcgtgccgttcctgttgaaacattacgtcgccctccgggacccggtcatctgacgggggaggttaagcgtggcgacaatattaatactctgatggatttattgcctgagggcacaatggtatcgctcactattgtggcgcaggctcaggacacgctggaagccgggtttgacacgctgggtaaaaatgcaatagggcagaacacggaatccaggcggacccgtagtgatgtggagcaggtgaagagtttgctgggcatgcgtcacaaactttatcgtgcatcgataacttttttgatgcgtgcacctgatgtcagtgagctgaataaaaaaatacagcaacttaccgctacattgctgactgcggggcttcagcccacgaaacctgaatacgaagtggcgcccctgaatgactatttgcgagcgcttcctatgtgttttaacccgcaactggataaaaaaaactggtatacccgcctgacctgggttcagcatctggctggattgcttcccgtgaccggtcgcagccagggaaccggacaccccgggtttagtttttttaaccgtggcggagaactgttgtcttttgatcccttaaatagtctggacagaacgcagaatgctcacctgttgctttttggtccgaccggggcgggtaaatcagccaccttatgtagtgcgttatcacagttaatggccgttcatcgtccacgcctctttattgccgaagccggcaacagttttggtttgctggcggagtatttccgggggctgggactgagcgtaaatgtactgagtatcaaacctggctgcggtatttctttaccgatgtttgctgatgctcattccttaatgcgagtagatccaaagaaaaacgtggtttctgaggaagctctacctgagctggagccagccaataccgacagcgcagaagatgaaagtgaagagcgtgacattcttggcgaaatggaaattgcagcccggatgatgatcaccggtggcgagaagcgggaggaggaacgtcttacccgggctgaccgcggtcttattcgtgaagctatcatgatggcggcggagaaaacatatcaggacggacatcagatgctggctgaggatttacaggctgccctgtggaatatctcacgtgataattccattggtgcaaatggcgagcttatgcggaatcagtcccgtcgcgatcgtgctgctgagatggcagaagccatggccatgttcactcagggatttgagggagagttattcaaccgtccgggaacaccatggccagaggctgatgtcacactgatcgatttaggtcatctggcacgtgaaggctatggtgcacaaatggcgctggcgatggtctctttaattaacacgattaacaatatcgccgaacgtgaccagggaacagcccgggatattgtggccgtatttgatgaagcccatatttccacgacgaatcctttgttgtcgccctatatgaccaaggttgtgaaaatgtggcgaaaactgggggcatggctgtggctggcgacacagaacctcgaggattttcctgatattgcgcagaaaatgctgaacatggctgaatggtggttgtgcctggttatgcctcccgatgaggtggagcagattgcccgtttcaaaaccctcagcgaggagcaaaaagttattttgcgatcagccagtaagctcaaaaactgttataccgagggcgtcgttttatcaaagcaggttgaggcactgttccgggttgtgcctcccagtctgtatctcgtcctggggatgactgaaaaagaggaaaaagcggaacgtcagcggctgatgcgagagtatcagtgcagtgagcttgaggcagcgatccgggtggcccgcaggctggatgaggcacggggtttttgtccacaaaaagcggcctgaaaaaacaattcctgagccacgggcaatggccaagccctgtgaccagttttaccaatatcagaggagtcattgttatgtcatcagagtggttgtccggggaggctggacgtgaaggatctcttttgctcaatgatggtatttcaatggggggattatgagcctgttaaagcatgagcaatggttaattctcggtgaagatgaatcgcatcgtattccgcctgatgcgctgctgggtttgcctccgcagggtaaagcgtggatccgcaaggaacatgatgaggatatgagtcgtctgacttctcatattcagggagctcttggcaatacttatcgtggggtttgtcatccacagcgtatcgggcatcgtgcctgcctggcaatccatcttgagaatttacgcggaaaaaagctggatatattaattacggtaagcggaaagacagcattacctgcggaggaaagttacgttaatccccgatggtacatcgatgttgccgatgccgcagatgccctttatctggcgctgtggcttatcaggtagacaggtacactcgccggcgtaaaagccggcgtttcatattccgcttccacatattctgaagcggggaattattaaaaagcaaaacagagtttattactgcattacctctgcgtttttcgcacgctatccggatagttatcgtcaggagcgtggcatgaaacgaatcctctcttcgctgatattaatcagctccttttctgcaagtgcgcaaatcgttgtttacaccgaccaggggcatcctccggtcggtgtaacaccggctatccgggttgtttatctcgatgccagcgaacgctggctgcagcaacaatttggagagctttcttctgatcctgaacaggctgtcagacaggctcattctctgctgaattctcctgactggaagagacggcaaaaagcgcttatcgaacattacaggggaatgattgaagcatggcagcttggtttactgaaatatccggcggtggtttttgacaaccgtgacgtggtttacgggactgttgatatatcccgggcagtggcgctgcgcaggggagagaatcaatgaaatctcttcgtctgaagcgagcgttactgtcagtcatgcttatcaccggcggcatggaggttcaggctgcgttgaacactgcctcgattgtggccagcagtatttctccgtcgtgtatcagctggagaatcagcggtatctgctactggctgatgtgtacccctttcggttgtacagtaaaaacctcgataaaagtgcatcactttattccggaagctgttgtttcgacttatcaggcgtctggtggaaatccgtggaccgaaatgtcattagtgagtcagacggccggaggggtagagaatgctgtaacgggggcgttatccgggcttgctgccggtggcggaaaccaggaacagaaattcccgggtacccgtaagagtaatgtgcgatttaaatatgcagatgccattggccatccttcaacatcgattattggcggccaaatccccggttactcatgcaacagcgccgccacaccactggtaccctattttcttagcacgcttgatacgcttgcctggcgtactggtgttcctgaatcggtttatcctgaggcactcattcctggcagacgcgaaatcggctccacatcggcacaaaatatatggggaaatctctatccccgaagcggctttgttactcagcaggatgactacaaatccggggcaatcgttgcgcagcgtgtagctgacattatcacccgaactaaccagatccacgtctataagcccctcaccggaaacccgtctgccggttactggcctcccgaacctgttaaagagaataccggcacgcaaaatcataaatggcagcagttatcaccaacgctctctatgtcatgcagcgtattcccggatacaggaaaaattgcggaaaacggtaattacgcctggacactctggcagccatatagctgctgtaaacgccgtgggcaaacatttctctatagcaccgacataaattaagtggagtatcgaaaatgagatctcaatccattttatccgtctgtctcatgctgggtatcgtcagttcgggaccgttaagtgctgcattactggatgcccccacgttgagtggtgatggatatggaaagtcagtaaatggcgcggttagtgacaagctgttttacagcattggtggtggttcggtgatttccactcccgggacgatgtacggaatgaaacgtatcgggctggatgccggactgagcagtgatttgatgtgtggcaactttgatataaagactactgtcggaaaccagcttaatggcgtcacgaatggtttcaaagatttgatgggggatgtgatcaccggtgcgaccggggcggtctcaagtatgccggcgatgatccttcagcgagcaaatccgggtttgtatgaaatgatcaccaatggtgtacttcaggcaggtctggcttttgacaaatcgaaactgaattgtgaaagcatggccaacaagctggctgattacactttgggtgacaagagcagctggacagaatcagctgtgagggaagagtacaaggaggcggtcagtgccagtggcggggatgcgctgcgggcagaagaggccagaaccaaagcttcaggtaaggagggcgctacctgggtaggcgggaagaaagccggagggaaaggccagcctgccattcagccaacgcgtgatctggctaaagcaggatacaacatgatgaataacctgagcgttaccagcaacagcacggtatccgccggtagttgcaaggggtcagcatgccagaaatttaaaaactctgaagaagctgcagcagcggtcgtaaaagttctgggcgatcggagtattcgcacctgtaaagatgccacagaatgcggaagcggcgggattgataatgcccagggcacgacaattgccggtaccggttttgctcccatgcttgaggatacaaccaaagagaatctggaacagctggtaaagcttgtaaatggtactgaggctccgactcaggccaatctggataaaattaaaagtggcagccttaaggtaacgcgtggtgtcatcgatgccctgaaacgcgatcctgatgccggtgcgttggttcagagactggctggcgaactggccatgtccgacacgattgaaaccggtctggcgatgcgtcgcatgttaacgactggccagtctgaacccaatgcagctgatcagcctcaggcaatggctgaagccgatcgccgtattgaagctctcgatcgtgagcttaactctcttaagctggagatggaactgcgtcgggaagtggcaaaaaataccgcgctggttgtggttgcgcgcgaagaaaatcgttcggtcaccaatcctcaaaaagaatcgcagactaatgctgatacccggctgagtgagcttgaaacgcgtaaatcaggggacagccaatgacactgaggatcttaatcaaaacaacttcatttctgagatttattctgacgcttgtgttcatgctggttatgcttacgtgcctgtcccttgcactggctgatttagggtttcgttatcagtctgaaatagcccagttccggatctggatgaaggaaacctggttgttgtggcttctgtggcggctgatgctttacagcgtgactggttgggggatatggcgttgttatcactcccatggctcttctcaggctctgcgtcagagtcttctgcggattgctgtcgtttctgttggtttcgtcgcgatttgcgaatattcagtgttgaggtagaagatgacgacatcgagctatcttgagtacatcctgacgattctgggctgggttgttaataacggtttgtgggatgttctgacaggcacgggactttttgcattaccactgggctttaaaatcattggtatctggatcaaaacacgggaagaaggggatgatgagggtaataaaggtatcctgtcggcccgacggatggaacatgctatttacggggcatttatcgttattatcgcctgctgtgtccccactcagacagtgtcactgacaacgctgacgtttgatacaacccgtgcgaaacagtgtggtttctggacaccggtcaagcccggggattcaggctacggtagtgtggtttcaacaatgagtggtatgactgcatctgcgccggtgtggtgggcatttatgcatatgatttccaaaggcgtcactcaggcggctgtggcaagtttaccctgccggccagacctgcggcaggtgcgttttgacgttcagcatacgcagatcaccaatcctgctctggctcaggaattgcaggattttaccagtgactgttatgcacaggcttttgcgttatggaaacggcaggatgcggggagaactacggatattgatgtactcagggatattgaatggctggggtcgaaaatatttttgaaggatttttacccgcagctgcattcgaagttgcccaggtcagcgttcccctggtcgcaaagccgcgatgacgggtacgcaaataccgggcagggggggtatccaacgtgtagcgagtggtggtctcagaacaagacaggcctgaaatcccgtgtgctggatacggtaaataccaccacgatgacacgcatggcggcagcatttaagggaatggtcagcaaagaggaatacacggaagcgctaattcgacgtctggtcagtccgacaagtctctctgtgtcacagaatggacgtacttatgcaggttatggcggtaatgccgattttacgttagataatgctgtaaatcgcatggcttcagtgctggggaccagtgtgggtgcccttggggcgttccccgcatttgatgccatgcgccaggcgttaccgatggttcaggcacttttattgatggccatgtatgtactaatccccctggtgctggtattcgggacgtatgaatataagacagtagtcactctcacttttgtgacgtttgggatgcattttcttacgttctggtgggagctggcgcgctggctggatagctggcttctggagatcatgtatggttcggacagccatagccgatggaatgtggccggttttcagaatagcgcagatgacctgatcatgaactttgttatggggacgatgttcctggtgttgccggcagtgtggatgggggcgctttcctgggctggggttagaattggcggcattgttgacactaacttaaataagggagtgcagccagctggacagcatggtggcaaagttggtgataaaattggctcgggaatagctaaataagaaatcgtgaaagcactgtaaatattacagtgctttcataggtcatcctcattatctatcgcatatattaagtggcatactggaaactctggtttccattctttatattcccgttttcggggcacagatcaaatataattaagaaagcacattttaatattgtcatttcactaacaactgaactaatgcttagcagggtaattattcaacatagcagggagatggttttcagacactcatgtcagataacgtcattatgcaacgtaatcaaatacagaagatcagaaccggggaggatgtgctgtctgcggttacaggccgtgtggagtggatatttgataccttttctcaggtttgtctgtctttttcaggtggaaaagactccaccgttctgtttcatatcgccgccacaatagcccgcaggaaacaccggcgtttctctgtcctttttattgactgggaagcccagtatcagtgcacgattgagcatgttcagaaaatgaaggatctctacagtgatgtgacggagacgtttttctgggtggctctcccgctgacgacggtaaatggtgtttcacagtttcagccagaatgggtctgctgggagcccgatgtggagtgggtgcgtcagccgccgacagatgccattactgatacgacgtattttcctttttaccgttacgccatgacatttgaagagtttgtcccggcattttcgacttggttcacgggcaatcagtgtggagtggccatactgactggcgttcgtgcagatgagtcccttaacaggtttataggccttaccagccagcgaaagcttcgttatgccgatgacaaaccctggaccaccgcctctcctgaggggttttattacacgatgtgtcctctgtatgactggaaagcccgggacatctggatttaccatgcccgtacgggcgccatttacaacccgctgtatgacctgatgtacagagtcggcgtccccctgcggaatatgcgggtctgtgaaccttttggccccgaacagcgccgcggtctgtggctttatcatgtactggagcctgagacctgggcgcgaatgtgtgcccgcgtctccggagcggccagcggggccatttatgctaatgaaagtggcgcttattttgccctgcgcaaacgcatctccagaccagcacatcatacctggcgcagctatgccatgtttcttcttgatgtcatgccacaaaaaacagccgagcattaccggaacaagatagcggtatacctgcgctggtatcagacgcacggttatccggaagatattccggatgaacaggagaatgacctgggcagcagggatattccctcctggcgtaggatatgcaagacactgattaaaaatgacttctggtgccggaccttatctttcagtcctaataagccccggcattacgaacgttacctggagcgtatgaaacaaaggaggaaggaatgggggatattgtaaccagggaacaggtggccagtctcattacccggtatttcagtcagcagctttcagatgacgaaaaagtggcagccctcaatcattttcgcctgacacttcatgagctcagcccctttgcccgggagcctgtggacctggtgctgtgggtgaaagccagcgaagtggtggccaacgattacaaccccaatgttatggctgccggagagaaaaaattgctgcagcactcactgcaggaggacggctttacccagcccgtcgttgtatctgaagagaaagggcagtacctggtcgtggatggttttcaccggcagttgctgggcagacgcgagtcaggagcaggaaaacgcctgaaaggctggttgcccgtcacctgtatcaatcccgaacgaaaggggaaggctgaacgaattgcctcgacgatcaggcataaccgcgcccgagggaagcatcagatagcgtcgatgtcagatattgtcagagaccttgcccgtctcggatgggcagatgaacgtattggcaaggagctgggaatggacagggatgaagttcttcgtctgaagcagataagtggactgacagaattatttgaagaagaggacttcagtccggcctggacggttcgctaaagtggacagcatcttatcgcaaataaaactatttcggccggtgacctgaattattatttaatgattaccaataaagatttccgtataagaacagggggcattttgccccctgttctctcggttataaaagcaggttaaaagttattaagcctgtatcaacttaattctgcgtctggcatagaatgtttcctccgttatctcaagacaatattaagtctgccttaactttctcgatttaagcatttttgccgtaacgccagttatctgcccggagtctattcgcctcctgatatctgccgaactcagcataagttgtattttcattatggacagcaggcttacctggaaagagcgggttaacctgattcggacacatatctgatattgcctcgttatactggtcagacagcgctcctgaatacggaaatcaagttgacctgatagttttgcattgttttgcttcagaacagcagtgtcataggcaaaatgcctgattgtggattcatcgtttgtcatcagccggtgatgaagttcctgatttattttgcttacaggaaggcgggaatacagcgctatattccaggtgtaatcgcagtgagtacatttatagatactccatacgtccagtattttcttttgtgaattaatcctgaatgcacctgacggcgtgaagtctctttttacattgcatgacggacagcgttttgcgatgtgctgataccccacaggagtgacagtccatgttactttcataattaaccttttttacccatacaaaaccggatctgtatggaacggaccatagagatttgtgtgtgaaaaataatcagaagatatttttcagtgggttaaaaaaagatttccaacactaccatcctgtcaacgactgaagcgatacgatcagactatcaaagaagtcttcttcagatatatgcgttaaattaatattggcgtcgtaacccgcaggcttgcctttgatgaagcggaatatgatatttagccttttaagcaggggggagttgtattgatcaacgtggcatcaatgatctactatacgaacgttgtaatggtgcattagctgcacccaccaatgccccggtgatctgagaggggcgccttcgggtgattgcataccaatgtcaccgtagcctgagaggtggcgccttcgggtggtacagccctttaatctttggaaacggctgtcgtgtacttctgcgacgaagatatttttactacatgtaagtaccgtttttcggtatcagatttttgacctgtcttcacgaacagtggacgatcgcttcttctttctacggttttataccgtatcttttagtactcacttcttaagcctccgtgctcagacaacctttgcatgtacgggtatgccagccatttggcgcgacgaacgtcgcaacatttggggcatcttccggacgatgcattggacagtttgagtatacgcggcgtcacttgcgttcgagtaaaacgagaaccaagtgacgccgcaaggcgtaaaacatcttcagcacgtatttcctgatcttccgaacagtttaaaaagtgcattcgttcgtgaaaccagtttgaggaatgcgctgaaaaaacgttttctacaacgcccgtcgcgtccgttttccacggacggccgctcagggcccgtgtttaacccgttgttaaggtttcatctgtgaagcttaacgtaatgattaatggaggttttatcgtcatgatattgaggcgtcagtaattactgacggggagttaaattcgccgtactgcgtactggttgaactcctgcaaaaactcaacatagcgctaccctgctacacaatatcagacgagtcaggaagacgaacgcaccgacacgcagggaacgtctgtgatgacgaaaaactaatatttccagctggttatgacagttcatttcatgagtgagaactatcgacaagtgttctgactgatgggatgcgctgagggattagtgtgtcttttttcaccagtgtcatacagggggcaatatggcagggaaaacagctcgttcaaaagtggagaaattccgtcgcgattttgtgaccttagcccgggatgccggcagggcatacgcgacggctgcagacagcatgcgtatcgcgaaatactttctgaactaccttcgtgataacggtattaagctacgtcataccgacagtattaaaacacgtcatgtcaccggatatctccagttcagaaaatcacaggggatttccgtgcggacaattcagaatgagcgggctgctattcgtggcgttttgaataaggcgggacgttataagctggcagacccgaataatccgctcctgagtaataaggctcttggattagaaaaaagtagcaggtcgggaacaaaattaccgttaagcccggaagaatttcaaaaggcatttaaggaggttgagaaaagcaaccggggggttgcagcaacaatgttactttcttatacgctgggtttaagaactaaagaggcagtggagtcctgtaaatccgtgatgacatggaaacgtgctcttgagtcaggggaacattcagttcgtgtaatttttggtacgaaaggaggaagaggacgaaatacgctgattgttgataaggacgctttaaggcatgcaataaattatgctgaaaaagtaatgaaggaaaataacggtaaattgattgatcgtcctgatattcgtaaggcgattgatacctaccgttatcatgtcagacgtgcgggtctgacaggtgaaaaagcacctcacagtatgcgttatcatttttcacaggaagctcgggaatattatgagaagaatggtttttctggtaaggaaatatatgctcaggtgtcaatggatttaggtcatggagacggaagagggagatatgtaaaacaggtttatttcagagatggtactgaagatgagtaactcatgttcagtcgatgaggcagggaatgttttttagggatttgctgattctaatgagggtttacattaattcataaaagcagatacacagaaagtgattatttgcgtcagtatgaaagattgactttcagtggagtgttttttagtacctgaaatttccagctttatctcgtgcagacttctcatgtacctgtctttagcacgttaaaaaacttcagttacggtcttgaattttcattctcgctctggttaatatgatagcgcttaaaacgttgccttaggcaaccaccaatgttccagtgatctgagaggaacgcctttgggtgatcacataaccaatgttccggcaatctgagaggagtgccttcgggtgattgcacaccaatgtcaccgtagcctgagaggtgacgccttcgggtggtacagccctttaatctttggaaatggctgtcgcattttttgcgatgaagatatcctcaacattcacacttcgatactcgtctttcagcatttccggtgggaaatcttcccactgtggcaggttttataccggtattccgggtacagactgttgatcattttggtccagtgtcttctttgaaggagcgctcgttcgtatcgctcgctttgagacgtttaaaccacaaatcttacatcctgcccatcggggaaagcctccccgatacggtgatggttttctccgttttacttctggagaaaactatgaacatctttctgacttctctggtcagtattctgcgtaaggcacttccacgtatacgtcacggcaaaagtgaatggatcgccaatcacaccggttatctgcgttttcaggcagaggtctggctggatgataacgaccattttcacgcagtcgtcaacaaacgttccggctggatgaatccacgctatgaacaggtggtggattgtggcaagtttgattcatttcactgtgccatgaataccgcgtactcccaggcacttgaacttgcacatcttcgctatgcctgggaactgaccgattagaaaacgaatttccactgcattaacgttaccacccaacaggggatttttccccgtagggggtaaatccctctgttgctgttctgacaggaggatttatgaacgtttatcaactgaaaaaccgcactgacgttttgatctggctttcgctgattgagggcgatttgctgagtatccaggcttctctgaacgccggtttatatccgctttatgatgacaggcaggaggaaccggagtttgaatgtgcggtatttaactgtggtatggctttcggagaatttatggaaaggcttgaatcagaagatattgacgttctgacaacagccggacatgaactgactggctcgattgaacatatggggagaatgttgtgtgaacccgtttggacacaggctgttcttctggggcgcaatgaagcccgggcagaccgggctatatgcgctgcagaagcggatggctggctgtatgatcctgcttagcatgagattgtttttaactttttgaggtctgtactacaggcctgtctggggcggctggctgagcgctgccgttgttttgtggtgctccccggaacattaccggctaaccattcctgtttttcgtctgtcagtggcaacccgataagggaacagctggcggttgaaagacggggaatgccatagtatcaacttttttacccttgcggggatgcccgcaagggctcccgcattttacgcaggaggcctgatatgggttgataattctattattcatattttccgtcgttgttgacggggtcgtattgttttgtttcacaccccggggcccagccccgtcaggggcaggttcctttatttctacagggatcctatgtctcacattcaccttccgtcggtttgtgaaaaaaccggcaacacactgactccggagcaggaaaaccgcgtgcgccatctggtgcatgaggagtgttattcccgcgaccgcgcagcactgataaagcttattggcctgatgctcctgctgaagctggcgggaaccctcatgctggcaatgttgttactggtgctgcgtctgttctgagaagaaggagattcacaatgatgttaaccacccgcttgtttgtatttttgttgcaccatctctggcgcgtcatgcgctggaccgggctgacggtgtatcacggtatttcggtgttatatcgtcgaagacaggccagactgcaggcctccgactggcgcccccgaacggtgtataccggtcgctggcagctggccgatgatggtcagttctgcggtcgggccgttgttctccggctcagggatgcgctgaaacccggcgtggagctgctttacttcggtgaagaggctgcggagccgtattacagcgagagacaatttgtagacgacagggaatccgtgatggtggctgagcagatgttgctgcggtttcttggcagccggcaccggcggcagaaccggcgaaatgctccagtgtcagtgctggttactgacgtagtgacaacagccccggttaatgatgaggccgcatgatggatataatggcgctgctgagcagcacgccgccggccgtcgctatcgaggagccggtctgggaacaactggtaaaatacccccaggctccggactgtgaaaacgaacggctgcagcggttgatataccacggttttcaggcactcagtcaggcaccttcggggcagggaatagtggagtttggctatttctgtctcccgcctgatggtgacctccatgccccattgtggcagaacgtatgtattaaacgtgaatattcagacggtcaggtgacactcactttcgatcgttaatcagttttaccacctaccctgacggggaaacccgtgagggggacgccgtcagatctttttactcaaaaggagtctgtatgagcgtaatgaccactaacgaaacccctgcatccacagtagcagaaccggaagtttttcgaagaacccgtaaccgtttcaaccagtggttacaggcggaatttgaccgacattatcacacgatgagggatggcggttatcgcagctttctgaagaagaaccatccgacggagctgctgcgctatgacgaggcatgcgaggccttaaggcgggaagaatttgcccgctttgccgagctgcagacgctggggctgtacctgcatctgcaggtacagcaaaaagaggcgcagttccggcggcggcgtaaccgtctgctgttggggatgaccttaacgggcgtggtgacatcagtgttgttatacggtcactttcatcctgagcagtttttgctgatcggacaggagctggcgacgttgcctggccgtatcctcggatttgttggtcggctggtaccgtaatcacgtacgcatcctgcgttactgaaccttatcccgtagggagagtgactccctgtgggggcgctctccctttttttcaggagagcatatgaacacatcgttacatccggatgatatcagccggtttatctccggccgacttatcagtagcctggctgcaggccaggtaccgtggcggggcacaattcccgggttaccggaacacgcgcttacgggcgtgccgtttaccggtattaacgtattgttattgtggcaggccatgcagcagcgttcgcttcgttcaggaaggtggctgaccggagatgacctccgccaactgggcggtcaggtcagatccggtgaaaagccagtcaccctggtccgctaccggccttcgttatcgcttttcaaggtaattaaccctgaacagtgtgatggtctgccggatacgctgcaaccggggtggccactgcctccacgacctcagccgtcactgaatgtgatccgcgacctgcttcagaacagtggggtttccgtgatccacagggacaacgttttgccggtataccgggcattgcatgaccggattgagcttccacccgtggcatcgtatgtcggagaggagacatactggcaggacatactgaatctgctggttcaggctaccggacatccgcagcgcttacatcgcttcggattaacagtggatacacgtaccgatgaggttcatgaggccctggttgcagaactgggcgccgcatttctctcggctgctctgggattaccgggagcgatgctatccaggctggatgtggcaccctgggtgacatatttacagggggacccgtggcgtctctttcgggctgcggaagcagcgcgaaaggcgatgatgtggctgaaagagcgaagaccctcgatgacgacagtggagatgtggcagaagatggcctcattgattcttgaaacgcattacggtttttctctcgatgacaccacgctgggatgtcgcagtgtggttgagcggcatattgaatgtgggatcactccactgatggcgattaatgcactggcccgcatttaccagtgggaacgctacgaccagcctcagcggtcgctgtttatcaacgaagcaggaccagacagtgaaatactgactttgtctgaaattcgtcccgaactgctgacctgttaccgcgtgcctgtgccatccggtataccggacaggaaagcggaagcggtgcaggtcgaaagtttacctttgctcctggcaccggcggtgtcggaaggtaagagtgcggcgaatgatgacgggcctgatgacccggatggtaatgacaatgttgtggcgctgccctgggctgcccgcaggggaaaggagaacccgcatatacatcgttttgtcagtatctttaacggtattgcacctcatgaaagccgctggcaggtattcagtgatttcgtccatatggcggcctgttcactgtacaacgctgtacatcgggatcctgattttgaagcggactacatgaggcgggtatcccactattcagctgaagatgcaaacaacatggcccgtttactgtcagaagttgttatggggctggaattcagtccaacagatttcctggggcgaatttatatgatatccggactgggaaattttcataacgcacagtatttcacgccttacagcgtttcgtacgcgatggcgcgaatgacactcagtgaccgtatacctgaactttccagcggggaacgagactttattactgtcagcgatcctgccagtggtgccggaagtatggtcgttgcgctggcagaagccatgctggaggcgggatttaatccgcagaaacagatggtagcgtactgtgtcgatattgacccggtggcctcgatgatgtgttacatccagctatccctgatgggtattccggccattgtggctaccggcaacagcctgaccgtggagattaaacgggagatggcaacaccaatgtttgtactgggtcgttggcatcaccggtggcaggcagatcggacgcgtaaagcggcctagttgcgtatttatcttcatcccgacagggttctccctgtggggagaattcctgttctgaacaggagtcacttatgctggccagtttctatattcaacggcagctcagtaaagcactgggcctcagtgtgaacgctgaggaggttttttaccaggtggacgatcgggagtcggattacgtcaataccgatatggtactgaaccgtgaccggttattgtccgtgatgcagtttatgctggatgacgtggcgcttaatccggagctccgggaaagatgccgtcaggcagagcgtattctgacactatggattcgtggtctcgacgcgctggcaacagtgtctgaggatatgtcgatactgccccggacgattacggagtgcagtggacgagttgatcgtctgctgccgggggacccacaggcactgctggcgctgccggatgatgcattcttacgcctgaccgcccagtgtcacctgatgtccggagagcagttcccccgggaacagcttgcagcgacgatgccttactggacgcgttttatggcgtggatagcccgtgaactttatcaggtggaagatcgttgtctggtgcaactcgggcgtctttatcgccggctgcacgtggagcccaggaaaatacggtgctttaacctggctttcggacgtattgagctgcatatgtccggacgggatattgatgaatgtcagtatctctacgcgtatgacgacgcatcgctggaagattatctggaggaaattatggccggtaatctgacgccggttcgctttgaagtgcgggtaatataccgcaacgattcggagctgaacgtcttcaggcgagacgccgacgtgattgatgtggaacatccccatgtcagcgactggcagaatgttgtcagcgaggccctggactggctacgccaggaacggacgtcgctggttgagatacctttaacccggccggcactgaaactggccgcctgattaaccactataccctcaggggattttcccctgagggggaaaatccctttaataaaccagagaggattttcccgtgagcattattgacgaatatatcagccagcatttctcagagcggctgtgtctggacgtaaccgaagaggatattacctggcagcttcgcggcagccgttccgactacgtgaatacccggatacagtttgaccgggaaaaactgatggcggtgatggatgtcatgctgtccggtctggacagtgatgaaaccacgctggcgcgctgccggcaggtactgacgctgtggatagccggactggatatgctgtcgaaggaggcagaacaacctgactggcttccccgggttcaccctcacagcagtggtcagtgcgacctgctgctgaagggaaaccctgcggcgctgacggaggcggacgaagaaacgtacctgcgggtgaccggccagcaggatttaccggcacaccggcgtattccacaggtgatattcagcaaaacggtacgatactggcaccgttttgagagctggctggcgcagcagttgcaggacattactcagcattgctatcagaaactgaaatgctttgtggcgaactgcacgacagagcccaggcagctgcgcgaattccgcggggagtacggttcactgcgtttatttgtggggccgcaggatatcgatgagatagacattctggagttcaatccggaatacatcgtgtcctgggtcgacaaagtcgcggacgggctttttactccagtctgctttgtggtgaatgtttactataaaaacggcattttgctggagtcgttcacctgggacagtgaggtggataacatcaacaggatgaccagcagcgattatggtgaggcgatgagccaggccatcagctgggtacgtgagcagtttgagcagccggtgattgatcaaccggtaccacagcagccacgactggctgcataaatcaacggtaaacccaccggggagaaactctcccggtggggatgtttctcccctttttttacaggagaaacatcatgctgaaattcagtgcaaaagacttaaaaccggtactgcttgaggcacgtaaaaaccactgtggcgtggtactggtcaaggatcatggcgtttatattatgtctgaaaccggtgagctcactccgcgtggccgaaaagtggcttatgcgaagggatgccatccagaaaaggatgaggcctggtgggataccgcccgggcagaagtagggggtgatgattttggtgagacgataaatctgacgaaaagcatgattaaccgcattctgaacgagaggaaaccgctgtatatcacggccagcaacgaagaatttaagatcgagtgttaaaactgagcgggtctccggacccgcgtaaaatcttaccctgacgggggtattcccgtcagggagcgtgcacgaaagtgtgatgaattatcaacgacagcattaatccttctggatgatcaattgtgcgtatgtttttgatggatcggtgacatctgcctgatctgtctgttgcacaattttccatccctcccgggcaagtgacgggatagttccggaaatgctttcgccgcatttaaataccgtgttatccgtcaactcggcattcgctgcagagttcgctaccgtctgtgatttacaaacgtgagcttctcctgccagtgccggtccagctactaacagactggttagtaatagtacgtttattctcatttaaacctcttttgttaacatgcacattaaaagaatggttattggcactacgatagcagttcttcagatggcaatgtattgattttcaaccatgaaattcagcctttttcactgagtctcaatgagctgattcagcgcaatcgtgcaacaggtaattcagcccagcgagtggtataagctggagagagtagctctcttttcatctgccactcaggggctatccctcttccggcaaaccacacttttcccatacctgaatggttgatactgtcgagaactttcatcaactgctcacttcgttcgtgcggctgcacttcatcaaaaagatttaactgagaaatcccggttggtgtgaaatcattgagcatgcaacccgcttttgcatatctatgccctttcacccagatccgatccagtgctttcaccgctgcggctatgatgtccctggtatcctgcgtgggagtcgtcagtttctcactggccacattcccgtaatacggttcgttcacagcgaacggtgacgtcttcacaaatacagcaacatgtctgcagaattgccgctcgccgcgcagcttttcagctgcacgctcagcatactgacagactgcctggcgcatggcttcatatgttgtgacgcgctccccaaaggatcggctgcagacaatctgctgcttgggtggcggagcctcctccagtgaaatacagctttccccgttcagttcacggacagttctctcgagaacaacactgaaatttttcctgataaatgttgggttcgcgcgcgccagctgcagtgcagttgttatccccattgtgtgcagtttcttcgagatccggcgaccaaccccccagatttcgtctactggctgcagtgacaatagtttctccgttcgctttggattgcctgaagtcagagcaagcacgccctcaaactgccgccattccttagacgcccattgtgcgctttttgccagtgtcttggtcggtcccatcccaactccgatggtcagtccggttcctgaatgtacatgctcgcgcaactgccggccgaagtcttcaaaatcgatacaactgtcaatattgcgcacatcaagaaacatttcgtcgatagaatactgctcaacgcgaggtgccagttcttcgagatgcgccataacacggttcgacatcgacgcgtagagttcgtagttactcgagaacgcaacgacaggtacaggaaattcggttgttttcagttgaaaccacggaacccccattttaatgtccagttgcttcgcttcttttgaacgcgcgataacacatccatcgttgttactgagcaccacaacaggtgtattacgtaaatcgggacgaaatactttttcacagctcgcgtagaagctgttgacgtcagccagggcgaacatcagtctttactccgggttttgtgtacgaatgcgatcactacaccgaatatctgcagctcttcaggatagaggacagggtatgcaggaatttcggacgcgggttcaactcccgccagcccaccaaataaaacaatgggttacgtgaaaacgtagtccctttttctttggtagtggcgacaaaatggcggcaagcatttatcgattaaaggactacagatatgaataaacctctaatagccttattgctcatcaccagcttcagcgcatctgctgacaaaatcccatcttctatccaaaacctgattgctgtttacgataccaggacgcacagcctagaagatggtgggctgactatcaggtataacaaacgacttttgctggtagatgcagctgaatcgatgttccaaggcatctgtaatgattattatatgaacaagtggaaacctggcacgatcaagagaattacacttcttaatgtcactagcgatcagggctttgaaatcaatgctggaggggatgagtgtagaaaagctggcacaatgaaagacgagcaggcgcgcacctatagaaccagctttattaaacctcttcaataatgaagtttaatgaaacccatgattttctttggtttcttgcggcattcctcccttgtctttttgagtaagaatgccatcaacttaccttaaaaattcatgtgcccttgcccactcactgttggatgtggaggagcgttatttaccaatgctggcgtaactataaagcgcactaccgtttcatgggtgacaaaggtgctaccacagttaatgttctggcactggcagtaacgctcttttgtgctgtccgtaacctgaaagctgctcctagtgtgcgctgagtgtccacactttggacaattcatcattttgagtttctccgccgccattaagttctcaataatgatacacaagaaattattattgagaacttatttattctatttctaaatcatcaatctttacttctagctccagactggtagtaaaaccattatccgggctgaccgtatgcgtcaacgttgtaatggtccattcggcatcgtcgataggctgcttaaaaccgctcacctttactggcatttcggtgtagagatctgcccgcccctctgcgagctgcagggagaaagacgcaacaccacgttgcaggcgctcccattgcatttttgccgcacgctcagcgttgccgcggttggcgtaggtacgattaagaaccagcacgttttcatccgttcccaccagataatcaccctgttttgcttccggctctttgggtgtggcgactttcttgtgacggcgctttacctgcgttgtttctttcttctttggttcacgtgtatgcagccaactggcaataacgcccgtatacgcgccacgatcagccaaggtaaaacgatgaccgtcaccggctttgcgcgtgatagtgataaccggcagcggcttgccgctcgccgttcttccctgtccctgccggataaacagcaggttcccgtccttaacggaagcaatcgccccatactgtctcgccagtttcatcagaaaacttgcatcgctttcattggtctggtccatatgatccagcaccttatccgtcaggtctttacccagcgccactttgaggttatgccgggcggcgatttcctttaccacctcccccaccgttgtctgatgccatgatttttcgcgccgggtattgagggtttcacggaaatcagcgctacgggcacggatagtcagacgatcaggagcaccgctgtgctcaatctcatctaccgtaaatgccccttttgggaaaagcggctggcccttccaccccagcgccagttgaataacggcaccacgtcgcggcagaacgatctgcccgtcggcgtcgtccagctccagatcaagctggtcagcctcaaaaccccggttatcggtcagcgtcagactcatcaggcgcgcatccagcgcggtggtcacgtccttaccttcaatagtgatactgaaagccgggcttctgctgttcaggccaaaaagatcagagctaaaattcactgcagcaaccctccaaccgtatttttaatattacctatcgcagacgttgcagagtcctgcaggttactgagctgatcgctgagactgccgaacatatcagacagcgactcatcaacccttttcagggtcagcgtaaactcaatacggcgagacattccgctttcaaaaaactctgtttttgtctgactcaggctctcgatcacaaacatgccgtaaatggtcccacttccctcaatcaggggccatgctttgccaagctctgccatttgctcaagtgccagcaatgacagcctgccgccggtgacttccggcagcagtacgccagataacgtcagcgggtcattatccgggccaagaaactgcgttgatggtcgccggttcacccgactgttggcggcgtgtcgccagcttcgctgatactgcagctcctgatatggcactgtacgcagcatgaagacatataaccccagtaccatcatcattattcatatcccccttgatcactgaaattactgcgtgctttagccctggtcttgcgctcgcgttcgtcaagctgtcgggcaacttcacgggcaatatcctgcgcactctgccctggctgagcatagatagtgatcggcgcgtgagtttcaaagtgcatcactggcggcgcgctggcagatttcgcaggctggctttgtttatatgccgcagtaggcagactgtaaggatgtagtggagcagcctctgcaggcgctgccgctacgcccatgacacctgcaacgatggaagccaacgcggcagtgcgccgcctactggtcacttttgcggggccgttcacaatttcagggccgttctccccaacaataccgaactgaccgcgcggaataatcccaccgctgtcatacatcccggcaaacggaacagcagcagccgctgcgccaccaaccacctgcacctgtgctttgtcttgtgttttattattttcagtcatccagtcaggcagataatcggtgactgaggaaagcttgcttttgagtgtctcccatttggcattaattccatcgagaatgctgtcaataatggcgctgcccgtgtcctgaaacttcgcaggaagcgcggaaacatcagccaggatcgcattccatttatcactgatagattgtctgatattggcccacgcctcagaaacgccagattttattgcatcccaatttttagctattaatcccggcaaggtataattaaagaacagtgacttaatcccctcccacgcggcgctggccttttctttaatccaatcccatgccgtacctgtggcattacatacggcatcccacatggccttgaactttggcccaagcgtgtcccagttctgccagatataaatagcaccagcggcgatcagccctatgacagccagtatagggtttgcaaacatcaatcggcccagccataaaactgatttcccgagccctcccagcgcagcacgaaccaagccacccaccgacgcaaacttcaggcccaacatgcccgcgctcactctgatgattgccatcggaccaaggattgatgccagcgccaaagagatagcccctacagccgttgcagcaacggcaaatcctgcagccatcttgaataaggcagacgtaagcgagggatggcgtttaacaaaaccgtccaaacgagaggctaactcccccagccaatcggcgaggttctttaatgcaggtgctacggtttcaccaatactcgccatcgcattagtgaatgtcccggtagcagcctcccatttattccccagggtgttcagcgatgcatcaacacgctccctaagcgatgcctgattttcaagctttgctgcagtttctctatatccttcaatccctttagatagcataatgttcagcgcttgtagcgtttccgcatcattgccaaacaaatctttcatggttgccatttgggtttctggatttaattttttaagtttctccagctgggcatacatattttccagaccaccaaacccacccttcccgtcagagaagttgaatttaatacccgcgcccttttctttcaggtcatcgttaaccgccttaatattgtcagcatccagagcggcctgaaaaatctttcggtatgcattaccggcagactcaccagccatactcccctgatcagccataaccaacaaaggcgcgaaagttttgaccgcttccaaccccttcttattgatgatattcatcgcgctgctgatttttgagaaaccctgcagcatatttcctgaatctacccccgcgtagaatcctttctggatcacgtccatcagattcatcatgtctttttcggaggtctgagtagcatcttgtaacttagccgcaaactcagctgctgcagtgggagccatctgtaactgcacgccaagataagctgctgactctcccaagcctcccaggatgacctgcgccgacataccctgacggcgtagcatagtcatcatgttctgaaagtcggctgttgttcccggcagcttatcacccaaagcaactgcaagccggttaattttttcaaattcaggcgctacctttccgcccggccccatcatggaaccggcgagttgattcgctgcattttctgattctgaataggcttttactggagccagcaacgtcatgccagtagttaccccagccgccatcgcccctgcaccattacctgccagagagttccttaactcgcgggtcttttcagccttggctttgatggcgttgagctttcgctgacgctcgccaacttcacgcagcctgcgctcctgctcagccaactgtcggttataccgctcagtttctcgtgcaatccgtgccgtctcacgcgctccgcccccagcagataaccccagccgataaagctcagctctggctgccgccatctggcgagtttcctgttgctgtttttgttcaagacgtgaaacagcacgccactgagcttcaagcgcctgcgtttgtttttttgtcggggattccaaagaagacatttcgcgcgtcatcatttgagcgcgtagcctcgcctgatccagttcggcaccagtacggctaacactttgagttagctgatcgaaagatttaagctgacctccagcatcactcagctttttaatctgatcgcgggtttgtctaatagctgatgccagctccttagagccagcctgtgcatttttaaatgggcgggttaacttatccaccgcccccagaactacctgcagtcgcaggttattatcactcatcgctggccccgcttctctgaattgccttatgccgccactccagcacatcagtcagcggcataacgtcagtgatggacggcgaccagtgaaagatggtggcaatgtctgccaccagatcatcaaccgtcaggttgtcggcaaatcggcaagcaccgacttcggcaacaaaaaagtcaccacctctacagccattgctgtcagatcggcggggtccagctctgccatttcctgcgcggtcagcgtcggggaagagattcgcgggatcacagtcatcatcgcgcccacgtccatatccataatggcctgcagacgggtgccacgcagcgcgccggactgaggcttgcgcagcacaatttcggtaatttcagttttaccgcgcatgatgggggtatccagttttacggtcttttcagtcagcttgtcgctcatgttcgtttcctgttaatgaaatactggcgcggctgcccgcgccgttaaggttaatcagaggccgagggcattacggtgttcttccatcaggtccacgccgccaacgatttctaccatgttgaccagatcgacctcatagagcacctcaccattaatggtcagcttcgcgtagctgttggtactgctgactttggtgctgctgctctcgccggttttccactcgccggaatccacctctttatgacgcccgcgcacaaccagctcaacggcctgcacttcgccggtatcgtcacgctgaatggaaccggtgaaacgcaactggatgccgtcaacggttgccttgcccatctgcttgaataacagcagttcggtgccgccgattgaaaattccgtgtccagtgcgccgtcatccagccccatgtctacgtccaccgcgcccggcataccgccgccgcgatacttctcaaacttgcgggtgaatttcggcagggtcagggactcaacgatcccctgccagttgttcccgtcgttgaacaggttcaggtgttttaacttgcgtggtaaagccatgattcccccttatgcagcgacacggctggcaaaatcgaccaggtaacgatcggtgatgcgctggcgcagcatcaggttttcaagcggaggcaccggcgtgtagtcataatcgatggtcagtttcccggctttaagggtgtctttatcgttaacagactcatccagccagcagtcaccaccaatcaggtatccctggttgaccagactgcgcatcttggcgcgtagtccttcaataatgtcgcgggccagcgacggattaagcacgccatccaccgcccacatgtgcgcctccgccatagtgtcagccagcacctgcgccgtgcgggtgtagttctcaaaggcaaacagcggatcgtcactgagacaacgggacccccagaagcggaagccgtctttgcggatcaatgtggtgacgtcatttttgttcagcagtcccgcatcggttgccgggtcctgcagatcccagaacacatcagcggaaatgccggtgacaccgttcacacccacattggacagggttttatgccagccgatctgctcgtcgattttggcacgcaggccgagcgcacgggcggaggcgtaagccgtcgcgtctgctttcagcacggtgtcaaagttgatgaagtcaggccagatcagcattccctcgcgctgactgaaattctcgcgataggcaatagcttcctccaccgttttgcagccattagcagcaaggtaggcaaacccgcgcaagctttgcgccacgcccagcagttcagtagcaacggcctgagtgtcatgtcccggcacctcaagaatgcgcggcttgacaccgagctgcgactgcgccgacagtagcgctttcatgcccgttttcttaccgtcggaagttacgccgccgataatattggaggtggtttccgcttcggtttcgccctgcgccacacgcacaacgacagtcacgggttttgcctgatctgcaatcgcgtccagcgagcgggccagcgtgccggactcccccgctttaccgctggcggtgagcacatcagtcagcaggacaggcttattgatggggaacacggacgcatcagcatcatcgccggtgcagaccatgcccacgatggcagtgctcaccgtggtaataggtcgggtgccctcgttgatttcaacaacgcgcaccccgtggtggtaatcctgagccataaggcagtctctccggttgacagggataccttatgttctggttgccaggcgtgcggtgcacgtatttcacgatgtgtcagtgctggtacaatatcgccactttcaacgcgactgatttacagggaatttcttgtaaagagtggaaatgctaacatcaaaaagcaatccaacacgatgacgagtttcaccggcggcaagcaaccgtccggcctgcttccattgttccggggtgagctttggacgcctgccaccaatacgaccttttgaacgcaccacttccaacccggcgctggtacgctcaacgatcagctcacactccatttcaatgccagaacggcaaggctcctcctgagcgaaaaggactttttttgaaagtttctggaaaataaaaatagtactatttgtagcattaattgaatcagccgaatttttctaattcatcaatcagatggacatagcatttgctataaaaaataaaagtattcctgctatctatatataaatgagttatgtacatataaaaggatcattaccgtgacaaaaataactttatctccccagaattttagaatccaaaaacaggaaaccacactactaaaagaaaaatcaaccgagaaaaattctttagcaaaaagtattctcgcagtaaaaaatcacttcatcgaattaaggtcaaaattatcggaacgttttatttcgcataagaacactgagtcttctgcaacacactttcaccgaggaagcgcatctgagggccgggcagtgttgacaaataaagtcgttaaagattttatgcttcaaacgctcaatgatatagatattagaggtagtgcgagtaaagaccccgcatacgccagccagacccgtgaagctatactatcggcagtttacagcaagaataaagatcagtgttgtaatttgctcatcagcaaagggatcaacatagcgccttttcttcaggaaattggcgaagcagcgaaaaatgcaggtctgcccggaacaaccaaaaatgacgtttttacgccaagcggcgcaggggccaatccttttataactccgttgatttcatcagcaaacagtaagtatccacgtatgtttatcaatcaacatcagcaggcatcctttaaaatctatgcggagaagatcattatgacagaagttgcaccactgtttaatgagtgtgctatgccgactccacagcaattccaactgatactagaaaacattgctaataaatatatacaatacactccctgaacacagaaaaaccaaaaaatatgcggagcctcttcctgattaatatgaaccaatagtatccataattttccccaggaactaactccggagctaaaccgtcatttaccagtgctaaaattatacactcaaccatcaaaaaaaatagccattgctgctatataacatatagcagcagtctctactacatatctatatttttatatctgagctggtttctccggccagtctgggttagctgtatccacccggtttaccattacgctataaagttcccatgcttccagccgtttaatctcttcatctgtggcaattttcagttttaccgcccgcgccagtggcgcaataactgactctgcctcagcaagaagttccgcttttctggcttcagcctgtgcaaccagctcttcaggcgtatattcgcgatgctcaaccagtaccgggcctcctttcctgtgctcgatatattttccgtccacctggccctgcatcagctcgcgataatactcatctgtcaggggaattaaatcgtcagggtaattatcggattcggtatccggttgccagaaaaaacctttttctttaaagctgtaataatattcgctcattgatatttatctcccaatcgcaaaccaggctacaggaaaattattgaccagattggccattcctgatgacttggtggcggcaaaaaactgactgttgctcaccgggtatccgaatgcgttatccacctgggtgccctgagcgttggtattggttacaaaaacggcaaagcaaccaacagggaaagcgcgcgggaaattgtaggttccgtttgagttaccaagtgttccccactgcattataaatccggtgctgtcgtccagaatccagccccagtcctgaatgctgccggtatttttacgggcgaaagtctggttaacataatcaatggtggcgcgggtgttgatgttgttgtcacgaattgccagttcactattgatccagtcaatcgttccacgggtatttagctgattagtaatccagatactcagccagttatccccccacactgaactaaaaatgtcaccattagtggtcatgctcgcattatcgaaatgaatatcagtgagcatgtgtaatccgttaccattgatataacccactttggcaccgttacagtaaatatccagtacgccatccgcgctgccgataaatccactgtcactgtcaccgatatttatacacggtgtgctgccgtcaaaaacgccggttccgatattgcctatactcacgcgttttgtcgggttcagggtttcttttaaaccgatattttgtacaaaccgcggcttgtcaggaatgtctgcaccgttctgtgatttttgtagcgcatcggcggcacgatttatcgtttctcctaaaccgaagtatgcgagaaggccggcgacatcttttccgcttaaattcgtcagcgtattgtccagcggctgctttccaccaagagcgtttaacatcgttgtggcaaaattcgggtcattccccagagccgctgccagctcgttcagcgtatccagtgctgcaggcgcagaatccaccattgccgcaatagacgatgccacaaattccgtgttcgcaatctgtttagtgctgttacccgccgctggcgtcggtacctttggaatccctgtgagtgtcgggctgtccttctgcgcatactgtgaatgcgggtccggcgcagcaagatgctttgccatcaggtcgtctacatataccttcagctccagcgccttatcatctacatatttacgggttgccagcactactgcagggtcaattttcagggtgatgttatcggtgctgctggtaatcagcaccatgcgcacggtctgcgtacgtccgctcccttctgtcagctgcggcttgtagctctcagggcagttacccacagcgatcagcgcaccggtttcatcaaacaggccaacttcacgaatccaccacccgccctcagtttccgggattacctgctcagcaataatctggctactgttctgcgggtcgatataaagcatattcagcgcagcccggcgtttctcatttaccagtgccgtctgctttgcgtccggcgttggcaatactccgccgccatcgcccaccgccatatgggtaatttttagcggcacaccgagcgcggcggcgctggcaagttttgccgcgccaatatccgtcagcagggtataaaattttgtgctcatggattcactctcattgtgtcaataacatggaccgccccgccttcatgcgcggtgccaccggaaataatcgtttcgttgatatacggatagatcgtgatttcttcgccaagatagctggcggctcccacccaatgcgggccgctggtctgcagattgatggacatgccgatcatgtggcggctacatggtttggcatcgcttatcagtcgctcaagttccagataggtatcttcagtgatgccctggtcctgcacgccgatatccaggcgaaacgtgcccggtgcctctccggtctgccaccactcaataatgtggatcaaaaagccgaacggctccaccacccgccgcacggcactggtggtccctttatgctgatgaatataaaaagcatccttcaccacctggcgcttgacgctttctgtccagccctcgtcccagcgatccacagagaacgcccaggcgagataaggcaggaaactgaccggacaggttgccggattccacaagtcacgaagcggcacctgcagatcagaaatcccgctgcaggtttgcgccaatcggcgctccagtggtgttgaacccggtggcagcagactattcatccgttcctccgttggttacgctccactgcgtacatgatgccgcctgtgttttgttcaggaccatatccgccagaggagaagccagctccacacgctgcacaccctcaacatgcagggcggcaaagatggcgctacggcgaatatcccgaccaagacgcgtctgactggcgatgtacttctgcaggctggcttttgccgctgccattaccggctctgcttccggtcccggatagagaaaaatagtggcttccacccggtacgggatgatttctgcgctgcgaaccgtaagacggtcagccaccgggcggacgttctcactgttcagagctttttccaccacgtccagcaggtctttttctgctgttccatcgccttcgcggctcaggacagtcagcaccacctctgcaggtgccggactggttgcactggcatctgccacacgtccgtccgcacttctggcgtgaaattcataggctcccgtcgggccagcaaccgacaacccctcaaacgcagcagggatgcgctggcgtagcgcctcatcatcttccatcactgcggcgaccggcggtactgcatcattatcagcaggcactacagtcaggcgtttcacgttgcagttggctgccagctgctcaagatcatttcccatcgaataggccaccatcaccgcctgcgcagcctcgttaatacgctggcgcagcaggatttcgcggtatgtgctttcctgcagcagcttggtgacgggttcagattccagcgccagcgtgcgccgcaccgcgtcctgttcatccacaggataaagagccacaaaagcggccttgcgctcagccagcagcgtctcaaaatccggcacgtccactatctgcggcgcgggcagccgggaaaggtcaatcactgccattgtctgctcctgtagttaccgaaagtgaaaccggcgcgccgttgttgcgctgcccggtaagctcaaccaccatagagccgtcaaaattgccgttgatggtgatggagtccagcgtaaggcgcggctcccagcggttcagcgccacatagactgcagacataatctgcaggcgcagtgccgggttctgcggctggtcaatcagggctgacagtagggagccatattcccggcgagcaagacgactgccctgcggcgtcagcagaatatcccgcaccgactggcgcagatggtcggtatctgcaatgacctgcccgtcattcctgctcataccgatatacaacgtcataccggacctcccgatgtatccccgcctgacttaacgccagtgtgaccgtgtttatccatcacgaccccgttagaactcattgcgccgccgccctgggtgacgccgccgttgatcaccacctcgctattaatgcgtgttgtgtcagcctccaccacaaactcaccggtttttagggtgatattgtccgccgcctcgatcaccatggatttgataccccggacatgccacctcccggtggcgggttcgtactcaaaccagcccccgtccgggtactccgtcacgcagccgtccacagaatccgacggcggcgcaaactgattggagtagatggcgggcagcacaaaagcggtttccagattgccgcccatgctcagcaccaccacctgctcatccggcgacgggcaccaccatgtacgggcaccaccggcacgcagcgtcagccagttaatccagttagtttcaagctcgcccactttcacccggcacagccagttttcccggtccacttcggtcacggtgccggtgcggatcaggttggtgataaggcgcatgatttcggtcagttgtgcattcataacgaaaggttgccatcagagggaaaagggaggcagcgcgggcgcttgtgccagcagtggcacaaagatcaccccgccagccagcgcagcagagtgtcacgggtgatggtttccacctcatcattcacgcccaaaaggcggcgctctgcgtagcggacctccgggccttttcggctgacgcgatcacgcaggccgtaatggtgaacacgggcaatacgctgcaccttgccatcaaactgcacgctggcggagtccgcactggcggcggttttcaggtattttgtggtgcgaagctttgcaaacatctggcgtttgatacgtcccttcttgctgcgggctgtcaccctgcgcggctcatagccgatgccgtcaggattacgctgcagcctgatgttctgctgttgcgtccggcgcaactgttgcgccagttgccgcatcatacggttgcgtgcggcaggctccagattcgccagcagcgccgtcagccagtcatcaaccttctgcagctcatccacgtttcaccgtccacatttcttcgggttcgtccggctccggcaccgcttcaacgcttgacacgctgccgtcagtgctgaccagcacacgctcagtcagttgcaggttcatgctgatatcgcacacatcgtttcgcagaatatccacttcaaaggtgaacagtttttcgcgcagatccgggttgttgatggcgtccggctggctggtactgagccacagcaggactggggccatcagcagattctggtcgccgctgaaatcctcgatcaccacgttcagggtgtagcggtattcccatgacatggaactggctcctgttgccaccagtgatccgttatcaacgaaaaggtgcagcttgtccgggttgtcccggacataggcaaccactttattcagggcgctgcgtaaggactgcggtttgttcactgtctcgctcctgacacgcaataattgtgtccactttgtcagcacagaccgcccaggcggcctcggtttcatccagcaccgcattcagatcgccgttactgcgcggcgctgacctttccaggcggcactgcgtcactctgggacagccactcacggtaagctgcacctccggcgagggccgggcggtcccgcaacctgataatgtcagcaggcaaaggagtgtcagcccagcggcgtaaatcctcgttttcactttttagctcctcgatccggcgctggcgacttcgcaacagtgcggtggtctgctccgcagccgcataaagccgcgtctgctcccggctgttggtttcggtcagaatggacaggccgatcagctggctgtttttcttcgtcagctcctgcgttttgcttttcagcgccgcgccctgcgtttcgatggtgtggctggcattgtttaaccgccacgactgccagcccagcgccgcaagtgccagcgccagcactaccgccagcgcacgcatcaggccgccatcggctcatgaagctgcgagcgggcaatctgatacaaaaccagcgtcagcaggtaaaacaccagggtgatcacccatcccgaaaacgccaggcacagaacaataagcagcctgatagcccatgtacgcacgggttttacggggtgcgccctgaatttgattaatgccgccctgacctcatcgcgcgcccgatctccggcgaaccacccgacagcgcacagcgcagcaagcagccaggcgaggaagcatgacacctggacagacgcaccaaccagaaccggcgcaccgctgcgcggatacagcaggctgattaccaacagcgcagcccatgccagctggaaaaaaacgctcatgactttctttttcattccgttaggctccttttaagcaccaggccatttcccgcgcgcggcggttgtccagcccctgattaaacacacctttgacatatacccagcgcggcagctgatggcaggcatccgcccagcgccgctggttcagcaacttaaccagcgtggagctgcaggcgttgccggtgcccacgttgaaagcaaacgacaccaccgcgtcatagaccttttgcggcatcggctgcaccacacatttttccagcgcccgctccacgcgcagcacattggtgataagtccctgcgccgcctgccgttccgtgatggtttttccaggcaccacaccggacgtattgccgatcccgtcagtccagacgcccgcgctacactgataaggctgcaggcggcatccctcgtaatcggcgatcagtttcagcccctcaacggaggtatgaagcgactgaaatccgggcagcgtggctgcgatagccagcactgccccgacaaggcagcacttaacgattgaagtattcatattccccccgcgaaatcttgccgccacgtaacaatttgaaagactggtgtttgtagtaccagttgatagccagcatcagcacaccaatcagtacgccgccaaccgttgacgcatccttgagcgacagatcgcccagccatgccagcagcacggcaatgcagtaagtgataaaggcgctgattcgttcaagcgtcataattcagtcccatagctggacggtctgcgccgtggttgacgccgtaatgtccggcagcttcacctgcagcccgtgcggtaaaaatgggccgtactcagccagccttggatttgcctgcagaacctgctcagtgacaccctgcgtgcgcccgtaatgacgccagcaaagcgcgtccaccgtgtcatactgatgcgcacgcactttcatcagataagctccaccgtacagtgcggtgcatcctgcacccggctgatggcccagcgggcatcacgccacagatcgccgctggcctccgccagctcctcccctcgcttcacgcctgacgccgtggcgtcatagtcctgataacgctcattaagcacagcgcgcgcccagcaaaaaacagcgttgtggtagtgccggatacgctcgcttttaccgtccagcatttctgcgggaacctcagcaagtgtccgccagcccagcatctgctgacggttgcggaagtcgtacagctcagcgttaacctcagagatcgccgtcagcacgacctgctttaaacgcggctgcgtcaccgtgccgtcagtgcgcatcacactgcgaaattccgacaggttcacatcaggccagaacggcgtatttttgatgacctccgcctgttccggtgcctgttctggcgcaacaaacttcatgcggcgttctcctgaataagtgggcggtggacggaattttgatgtggcagtgcctttcgccatcccgtgccgcccgtgcgcggggcacgttcgttagcggctgtcattgcgcagtctgcgctccagctgctgcttttcttttttcacaccgcagcggggatcaagctgcagcgcatggttaaggtgattcagggcagacgccgggttgctttcgctcagtacagcaccgatggctttatgcaggcgcgcccgcgactggtccggcatatccagatcggtggtcaggtccagcgtctgcagaagcggatcggcatcaaaaccggcagcggcaagcagagcgctttgcgccgcgtctgccatttcttctgccagcacggtctgcacgttacggttgcccagaggcatcacccagccatggcgcagcgcatggcgcccgatttcgagcgcaccggcataatcaccggcgtcgatacgccacagcatcacgtacatcagcacgtcatcctgctgcgcacctccggcagccagcacgccctccgcccaggcggcatatttcggcagcagttccaccttgatttccgcctttttcaccgtggactggacgcccttgaggcggcggcggtcttctgccagctgcagcagcatcaggtcatagcccgacgcatggcgaacactgccgccctcacgggcggcctgttcagcctgaatgcgcaggcggtgctgccgtgcgggactcaggctcatgcgttattccccactttccggtgcggcaggcgcgctgaaatcaccgatttcgatgttttctaccagcgccgcgcagcggtagtcctcgaccacatacgcctcgttgacggattcaaagttttcaatccggtcgcgtttcgggttgtcgataactgaacggcggcgggtgtcttcctgccagtagatggacaggttatccagacgggtgatcagcagggcatttgccgggaagaaaggcgcgcgcacagcctgcaggccgcccatgcgtttctggctgatgatcagatcggcggcgattttctcgctgttgtcctgctctttgttgaccagcgggaaatacttgtcagacagcagttcacgtccgcagacaacaaccagctcgtcatcatcctgatactccacatcgatcagctcgttgacggtatccatcaccaccgcgtcaagatttacatacttaccacccggacctacttttactggttctgcagtagtggtgccgtcttctgcggttttgctgcccatgacgtgatccggcgcgtcttcgcggattttctgcagccagcctttattgacgtcctgcagcagcgggttttcagcacggttggaggttttggcgcgcttcacgccgttaaagccgatcatgatgcggtccagcgcctgacgcttgacgatggcgttgcggatacgcacctggaagtcctggaatttcgcccacaggtccagttttgcgtaggtcagcaccgtatcaaagttggtctgctcgcatttgtattccacgtcttccatcagcgtcggatcggtaggctcgcgctctttggtggtggtatcggtggttccggcaatggtgctgccaacgcccagccccagcaactgaccggactgctcagtgaccggcgtgatgttaatcagcgtcaggaaagcagcagactgctggatgtggtcttccagagtctgctgcacggacggctccacggtgaacttgctggagagttcttcaacatccacaccattcaggcgcgccagctgctgcaggtaagcgttaaaggcaaagcgggttttctttttcatcgggttttatgctccatcagcaattggtcagggtgcctgccggtgcgtcaccgcccggcgcgcgctggcggtaatccttgcggctgtcttcgcggctcagttgctgctgtagctcggcaaaggcggtctgctgttcctgcagggaggactccagcgcggaaaggcgctcaccgttttcagccagggatttatcagtgcgctcgctcaggttctgctgctcggtggcgacaagttccacggctttatgcacatcggagaaacgcgcatcgtcggtctgctcttttttggtgaacagcgcggtgacgctggcaaagagggacggcttttcgtcctgggcttcttccagttcgatcagcgtttcaaccgcttccgaaaacaggttttcagggttctgcttacggtttgccagcgggttatgtgcggcgctggcgctgaaagccagcatttcggtgccaaggctcgcaggatcgtccgtcgcacccagccccacaaggtaggctttgccggtgtcggcaaacttcgtgctgacctccatggaggtgaaaagcttctggccttttttcaccagttccaccagggcgtcagtgggttcgatatcggcataaagtgccatcttgcccgccagcgggccgtcctggatttcttctgcaaccagccccgtcaccctgccatagcggttaaaagtgctctccggcagataagacttgatgtgctcaaggttaatcagcgcggtatagaccgtcgggttgtagctggcagccatctgtaccagccattcacgctggatctcgcgcccgtcagtggtggcaccttccaccccgatgcggaaacgctttgctttcactgtcatgagccgtgctccgttagaaataacttactggagtcttatgtttgcggtgatggggggagtgagacaacgcgctgtatttgtacggtaaaccacacaaaccgcagccggggaaagccgccatccaaggccgtatgtttgggccatgaacacgacactgacccccgcagacctcgatccccgtcggcaggccatgctgctgtactttcagggataccgcgtagcccgcattgctgaaatgctgggcgaaaaagttgcaaccgttcacagctggaaaaaacgcgacaagtggggcgactatgggccgctggatcagatgcagctcaccaccgccgcacgttactgccagctcatcatgaaggagcagaaagaagggaaagacttcaaggaaattgacctgctggcgcgccagtcagagcgtcacgcccggatcggaaaatttaacgacggcgggaacgaagcagatttaaacccgaaagtagccaaccgtaacaaaggtccgcgcaggcagccggaaaagaacgttttctccgacgaacagatcgaaaagctggaagaagtcttccacgcctcaatgttcgactatcagcgtcactggtttgaagcaggaaaaataaaccgcatccgtaatctgctcaagtcgcgccagattggcgccacgttttattttgcccgtgaagcattgattgacgccctgctgaccggacgcaaccagattttcctttccgccagtaaggcacaggcgcacgtctttaagcagtacatcatcgactttgcaaaagaagttgaggtggagctgaaaggcgatcctatggtgctacccaatggcgcagcattgtactttctcggcaccaacgcccgtacggcgcagagctaccacggcaacctgtaccttgatgaatatttctggataccgaaattccaggagctgcgcaaggttgcctccggtatggccattcacaagaaatggcgacaaacctacttttccacgccgtccagcctgacccacagtgcctatccgttctggtccggcgcgctgtttaaccggggccgagccaaagcggacaaggtagatattgacctgacccacagcaaccttgcacgcggcctgctctgccctgacggacagtaccgccagatcgtcaccgtggaggatgcggtgcgcggcggctgtaacctgttcgacctcgaccagctgcgcatggagtacagcccggacgaataccagaacctgctgatgtgcgaatttattgacgatctggcgtcagtattcccgctcagcgaactgcaggcgtgcatggtggacagctgggaagtctggaccgattttcaggcgctggcgctgcgcccgtttggctggcgcgaagtctggatcggttatgacccggcgaaaggtacgcagaacggtgacagcgcaggttgtgtggttattgctccgcccactgtaccgggcggaaagttccgcattctggagcgtcatcagtggcgtgggatggacttccgcgcccaggctgacgccattaaaaagctgacacagcagtacaacgtgacctatatcggcatcgactcgaccggcgtcggtcacggtgtttacctgaacgtaaaagacttttttccagcagtacgagagtttgtctacaaccccaacgtcaaaaacgccctggtgctcaaggcgtacgacattatcagccaccgccgtctggagtttgacgccgggcataccgacattgcgcagtcctttatggctatccgccgggccaccaccgccagcggcaaccgcccaacctatgaagccagccgcagcgaagaagccagccacgcagatttggcctgggcaacgatgcacgcactgtttaacgaaccgctgcagggcgaagccgccaataccagcaatattgtggagattttttgatgagtgaacacgacgccctgaccagcaccgcgccagtgcaggaggccgaacagcagaagaatacaactcacgccgaagcgttcagctttggcgatccgatcccggtactggaccgccgcgaactgctggactatgtggaatgcgtacagatggacagatggtatgagccgccagtaagctttgacgggctggcgcgaacctaccgcgccgctgtgcatcacagctcaccgatagcggttaagcgtgacattctcagcagtacgtacatcccgcaccgcctgctcagccagcaggcttttgcccgtttcgtccaagattatctggtgttcggtaacgcctatctggaaaagcgcaccaaccggctcggcggcgttctctcactggagccagcactggcgaagtacacacgccgtggcttggacctcgacacctactggtttgtgcagtacgacctgaccacgcagccctatgaatttacacagggcaacatctttcaccttatggagccggatattaaccaagagatttacgggctgcccggctatctctccgccattccgtcaaccctgctcaacgagtccgcaacgctgttccgccggaagtattacatcaacggcagccatgcggggttcatcatgtatatgaccgatgcagcacagaatcaggaggacgtgaacaatatccgccaggcaatgaaaagcgccaaaggtccgggcaacttccgcaacctgtttatgtactcgcccaatggtaaaaaggacggcatccagatcatcccgttgtcggaagttgcggcaaaggatgagtttctgaacatcaagaacgttagccgcgatgacatgatggcagcgcaccgcgtgccaccgcagatgatgggcatcatccccaacaataccggcggctttggtgatgtggaaaaggccagccgcgtgtttgtacgaaatgaattaataccccttcaagaaaggattaaagaactcaatgaatggttaggggatgaagtcattagatttgcgaaatatacactcgacgacataagctaattttattataaaagatggtgccatcatataacgatgacaccatcgcccctaaaatttatcaatttccatacatgaaatagcatcattgaaaatcgaaaaatgctcatcaggaaccactgcagaagccccactggttaattcaaaactaatctttgaatcaaggtaaaaccctcctgcttttattttatcgagcttgaattcactatccccaacaaaaatcttcaaatcatgcaaagcatcgccgctagaattcaattccaaacatgctcttgttttttcagtaacaggaagatttgacaccttcactttggaaatgccaaacacctttacgccgaaattttctcgaatgaccctcatgaaagctttaagatctacggttaaattcccataagcaacatttaacccttcggcctgagacaaaaaatcgataaaaggtttaactgtttttggaggattgtaaaaagttaacaaacatatcttattgctgagggtttggatagaaaaactaatctgatcaaatacaaccctttcgaattccagcacctcaccaaatggatcggcaatcggctctaaaacaacagattttttattgaaagttgcagtcataccattatgaatggtttcatacttagtaaaaccagcaccaatagcatcagaataaggcgtgtttttgataaaatcaaagacagcttcagggctggtcctgattttcaatctcatccacttcaatcttaattgtgacatagccactccttatgatgtattagctgatttccattataatagaataagctctattttcaattaatttattgaatcgctcagtttctctaccagagagtttttgcggcttactgaaatattgtccgtttgccttatattttctgactcccttaactaaatatgagaaattagtacaattgagaggatcaccaaattgggcctcaagctcaaatatatctggatctgccaagttctccttgaccttccattttattttccagatatagaatcctctatcataaagatcacttaattcatcagatttaagtaccccctcacccctaagtgatgccctagacacatgcactccagtttcggtgtttccatcttcagcctctatagtttcaggcttagggtgatatacataagcatcagtaacatccagtaactcatagccatcaagtgtacggattaatttatcgaagaataaagttctaacatcagcagatgtattgtgagagagtgaaatttcgtttaattttaaatcaaggttactatcatccgcttgctcgttctgaatagcgctgatgtgccccagtaaaagcccctcgtaatcgtcaaggttttcattatctggacgacggatactgtaaccatcatcaagaggctcaatttcaattaacgcctctttattaatagcctgtttgaaatcactttttccataattagttgaaagatatctaatattaatcagaactcgcggcccatccacgattattttacaataatcatcctgcccggtaatttctttcttaagtttttctgccgcgtctataatacctttcttatctataccagtctcaattcttacacatgtaattttttcggtccttgtctggccacctagcagggttgcaattttttgatgctcgtaataatcatgagtcattcgagaatagtttcttgccaattcctttcgaggagtttttttacatataatcgttcctctctctaagaaaaggtcttgaatttcatttagggtaatttgcttttggtttaaagcatcatacaaagctttatcagttacgctgtgaatatttttcatttcggctcccaagaaataacttctgcagagaagaattcttttactgtagacacaactttaacgtctaaatcttcaagcctctttttagcttcttcatctaacccatactcatgcgcatatttttcaactccccgttgaaaatgggagagaatcctctcatctttttctcgatatgccagccttatcctaattttatttataccatcaagaatttgataatttgacaaaatatctaacaaataaaagaattcattgtcgctgttaccttttttgttgtaatacacaacaaacccttctggataaacttcctcctcaatacctttagctctgttaaatttataaacagcaccatgtttgataaccatgaaaggtgatgacaagacttctatagtagctggaagatatttttcagtcacagcaaccttatgaaaagtcaattgagggtaatagaatccatattcttcatcaggaaactctttcttggcaatcaaatcattcatatcattcgttattgccaacatataattaatcagaaacggatcgattatatgaatttgctgacctgcggataaaggaatcttttctaagttgacagccttatctcttcttcctttagcgggtttgggaggattaaaaaactcataaaaatcatgctgcaactgattatcatgattaaaaacaaacagtaaaccgcgaacttcacagtcaatttgagaaaaattatatttttctgaccactcaggactatagcgagcacattcaatagtttttgctaatgacgccaatgcagattctatttttgacgcatttattgaacctgctttataactttttaaatcagtatttaaataaataactttgtttaaatatgggtctttataactaaatacaacatctacaggatgcgtgtgcttctgcttcttaccttcaggcttatgtttagcctcatcatcacaaaggaaatctcggtcgcaggggccatgctgctgccacttaaatcgactcagtagatcctccgatatgcgtttcgccaaatcttcaatagggccgttctctgccatttgatttccttacttttttgcagacaattctaattgaaagataaaggtaagcttttttgcttgcaaggactttggacctaacgtgagacgctgagcgcgcgctcgtatccccgccacgcctgcccgctttgtgtagtggttttcatgcacctgcatgacataagcaaaagcccgccagttctggcgggcctgagcaaaaacgatcctcaaacgatcatgcgatttcatgcggcatagacatgcacaacagcgctaacgcctcacgtggctcgttgttcaaccttgcggacggtaaaaaccagttttatcgtccgcaacgttcgctaatgtaaccagctgtcgtcctcccagacctgctgcattatttccatcactcgctttttgtcttcatccagttttaacccgctcagttcaacaccattggcgctgcccttgcggatacgaattgctgttttgggatacagagggcgcaaattacggtaaagctcggattcaagggcgtccagtgtagcctggctaatcttctgctctttatcgatcattatttcaatgcgcatacagatttcccttaactggttacgtccattgaccggcagtattcatggctgcggattttcgccatcagctcgtcggtcagttctgacacccactggatagccagccgcttttcttcgtcgctgcactcactagccgctacaagcttaataaaaaaatcaatgcgctggagcttcaacgactccaaaatatagtcctgcatcttccctcctatcacgacctcggatacgcattaactgtatgtatatccactgtttatatatacagtgtacccctgatatccaaaagtaaaatattttttatccgtcaatgagaacgttcttacgaaggtcgttaagagcatgaattgttaaagccttgccgtcagtatcactgacgccatttgtcatcttcctgcagtcgatggttgcggtaaaaaatccgtagcccggcacctgacggaatgctgccaccacgcagaagcaaatcaatctcagatgcactaccttcaaaccctctggctgtcagttctgcctcaagctgcaggcgttgctgctccgaaatattctgtttgtatactgttttccgcttcggttttaccagtctcaacctggctgtaagttcccgccgttccttctggcccatattgtggagataatcctgcagttccttctcattcatggttttaatatcgggtaaatcaccccctgatttgttcagattttcaacagggggacagttattgccacgagtccgagtccaaggggcgcaagcgccctggtcggctgccgcctcctgaacgtcaacggctttacgaacctttttccacttcaccgcgtgcgtgcaaatcttgccctccgcaatcggggaccagatgccatatatacggataccgtgatcgccgtaggcgctcggctcatcgttaagctcatatgccgtgcggacaaggtgatgtttgcggggaaccagcacaccgccctgcttcatgatataggtggcaaagcagcccgcatcagccgccgccagtaccgcatccagacgcggattatccagtaccggcgcacccgctttgcgttcgccctgcactctcgccgcctgaccagccagcaagcgcagctcgcggtatgcctgacgccccggaataccaaagaaacggaactgctggacacgatgcagtgacgcccaggcgctgacatgctcggcgctgtcacgcagtgatctgccggtttctttgctgatttctttagccagcccgcgcccgtcgatgttcttgctgatgtatttggcgatgtagcttgtcggcgtacccttgcgcgggttgattagctcgggcttgaagcgcggcccggtattggcgcccagctcctcgcggtcttcacggatggcaaacttacgcaacagcgcggtgatggaacggcggtcttttttgcgcatgaagcacagaagatgccagtgcacggtgccgtcatggtgcggctctgcaacgcggacgccataccagcgcagcccggccttgtgcattgccttgcggaaagcggcgaacgtatcaaccagatagtcactgctctgccggacagtggcactggtccacttcggattaggcctgccgttgttgagggttgcgtggaagcgtgacgggcaggtgatggtataaaacaccgcgcagtctccgcgcatttccgcgatcagctccagccccttaacacaggccatcatttcattacggcggtgcgccgggttgctgttgctggcgttcaccacgtcttccatgtccagcgtgtcgccgtcttcgttgatcagctcatgcgagcggaagaactccagcgatttgcggcgctgctcgcgtttgtggatcacggcttcgtagctgacatacggtgaggctttcttgttgaccaggcagacggcgcgcaactgctcctcccgccactcgcagcgcatctgccacaatttgcgataccaccagtccgcgcacagcatacgggccagcgacggtgggatcagttcataaggcaccggcttacggcggcgctttttgcggcgcaactgctcaaacgcaggcgggatgacctcaaggcgcatggcctctgcagcaaccctttcccatgcctgacgaatttcttctggtttaacatcatcactgacaaacagatcaccgcaggctgcatcaagacacatgctcatatgtgccgcaaccagcgtggataggcgtttaacctgatcctgattcatttcagggagtaccagcagcccctccagcccgtcatgactcgccatgaaccggaaagaggcagatacctgactgtcgcgcacgcgctccagccgctcaagacacggcctgattgttttttgcaggtagcgggaataagcttttgctctgcccagactatggaaatatttaatccgctccagcagaggcttgctgatatgcgccggttgggcgcccacgttggcaataatgaccagatcgggattaaaacgctgctgctcgcgcgccgttttggcatggttaatcagccgatcctgctccatttcgcgctggacaggatcacgggattcattgaagaaatagcgctcccagacctcatcgctcagcgtctcacggcgcaactgctcctgctcgttatccacagcgtaaagagcgatcaggtttgaaagcgcagactccggcgcaaattccgccgggtccagatacgggttaaccgctttttttggggtattccatggaaaggctgcggcggcctcattcgagccgccggtggtttgtgcataatgtaatgtgattttactcactgccacgcccgcacctcagtttccaccgagacatcaggaccagacgccaaatcaacaccgaaccagcgcactaacttcgtagcgatgatttctgttgcagatttaccatcacctgcagccacacccatgctgcgctttgcgatgatgcggtggcgggtgaaattacgatataaggaacgtgtcagagaggtgtcgctgttggacacaataatcggatgaccttctgatgaccggcgttcaagaatagacgccagatggtactgatcgtccccggtaaaactggcagtgtgataaccgctaaatgtgccgtcatatggcggatcacaataaaccacatcccccgcccgcagcattgccagcgtctcatcatagctggcgcagataaacgttgcgcgttgtgccttttttgcaaaagcacgtatttcgttttcagggaagtacggatttttataattaccgtaagggacattaaaatgaccgctcaggttatagcggcacagtccacgataaccatgacgattgagataaaggaaatatactgctttcatgaaatcagtaatttcagaggaatgattaaattcatgcctaatgttgtaataagcaacttctctattcgcaatcgcaaaaatattctttgcgcgtgatatgaaagcttcacaatcaagggcaatttttttatagagattgataagatctggattaatatccgcgacaagataatgaggatagtctgttgccatcatcacagcacaggaaccggcgaacggctccaccagtcgctgacctgcaggcagatgcttaatcagttccggcatgatggcggttttatttcccgcccatttcaggatggtgctcatttagcaccacctttagccagagcacggacaagccctaacgtcattttgcaatcagctaaagcacggtgcgccttaccttcaactacaacaccttcatgcgcagcagcatcaaccagcttatgccatttatagccattaaatcgtcccggctcgcctcgatactctgcataaagcttcatcgcgcaaacagaatgagcagcaagcatccatggcgcaccttcagaaggtctttcattcaatgcgtaggtctgacgaattaaccggagatcaaaatcggcgttatagataacaaacccaaagcgccgaaatagttcctccactgccccgcatatatcagtccaggcaggggcaaaagcaaccatttcattagtaattccatgaattgctattgcttcatcagggataggcttagtgggcttaataagcgtattaagcataataaacccatgactatcaataatgcatatttcaactatttccgcatcatcacccaacccggtcgtttcggtatcaataaataagtagtcattatcaagccattgatttgcacgttggctaattgtcatcttatcggtattcatacagcacctccattgtagtgtttgcctttcagctctgcgatttcctgacaggtgacgcagcactgcacgcccggaatggcgcggcggcgtgctggcgggatcggtgcatcgcaatcaatgcagagaacacgggaaacgcccggcgttttattgcgggcggtgtgaatgtggcgctggcgttcttcttcaacgcgctgctgtacgaggtccattgaatcagccatcagtggatctcctgcgcttcgttctgaatcttcaccgcttcctgacgcagcagctcagccgcttccgtgtggttaagctgacgtgacacgatacgggcagccaaagagtccagacgtgctgccatcacatcagcgcgtccacggcgttcttccatgcgtgcatcagtcagcatctggttaaggccagcatcatctggtcctgttttggtgattcgggtttcaatatttcgcattgttgtttctcctgaatttgggcaataagaagcccggcgggtttacgcctttaatttcggttgttggttaattcggcatggctagccgatttggaaataaactcaccactgtacggaaatggttcattgctttaatcagctcccgcttttcgtcagtcgtcagttcactaacattgacgctatgacgttccgccggaatctttgccataaagaatattgcggctagtgcgcgtttattctgctcatggttaatatcccgttggtcccgcatatcgctaataaagcgatccagttctgaatcaatatttaagccaaacactttcgcccttaattccgcgatgtggtttaacccattaagacggaggccagcgcttagcggaacagtcgcagcatcaccttcaatagccatggtttcccctgctttttagcggacagctcagccagcaacgcatcctgagagcggcacggatgccagcgcttgccatccttccccataatccagccatgaccgcagtgcattgcaggactttgcttaacgagaagtgatgcaaaagatggttctttagtcagcatagccacctcagatcagaccgaatgaagcgccgaggcccgtcacggtatccaccgcgcttgccatcgccgggttagcctgcaaacgtgcctgcatggaaacggcagccagtgccattagacgagtaactgagttgatgctactgataacatcgcggcggcctgcagtagttttcacatcacccgatacagcaccggcagcaacacgtccgatttcagcagtagcgctcatgacgtaatgcggcagcttctcttttgccacttcgttcatcggtatgcatggcaggcagtgaatctgtgccaggaaaccatctaccagcgtggagtcctcagtaatatcggtaagcagccagatctccgacggcgtgagctgatgcggttgttccgggttcagcttgttacgcagcgtctggactttcattcccgcgcgttctgccagcttcgccatgttgtgacgcagcgcgaaagcccggcaggcttcgtcaaagtgtggatgtttggaaatcttataatcaaacatgcaagccccttagaaagttctcataatcgaacttactgaccaacaatgacgcggaagttggaatgacccagagactcacgaacctggtcggttttgtacatcaggtaccgcaggcttacacgtcctttatttttttctttcttcaccatgtacttagcaagctgaccatggtgaattttttgatacaccgagccacgggagataccttcccactccgcgaactcagcaggcgttgccatctcttttggtacacgaattgaaatatcagtactcatagtgcagtatctcttagtttgggttcgttttatcttgttttatgtggtttgattttacttttcaaaccatgagcggatattaagatcactttttatatacgtcaagaggtttgattatgagtttaatcaaggcagggaatgatagtggtgggcgcgatgcgattaacaggcttattaaggcttacaatttcagctcacgacagcagctctgcgaacatctggaagtatcaaaaagcactatggctaacagatacttaagggatagtttccctgctgaatgggtaattcaatgcgctcttgaaacaggaatttcccttctatggctggctacgggccaaggagatatgtatgcgtgtgagaacgaagaaagaaatctcaaaaacgaaacctccgtcacggtaagaccactttctaaaattgttgctcctagcatcaaacatgttgaactgaagaacggtgaactgcagccaagtgatgaaattcttcttgatagcagactgctcgatggtgactcatccaactctttgtttgtaaaaacagctactgatagctttgttgtggatacgtctgttaaacaagtcagtaatggcttctggttagtcgatatggacggagttaaaagcatcgtcaaaatcgctcgcgttccaggcaacaaaattgtagttcaccaagatgaaacatcatttgaatgctcggtcgacgacattgaagctatcgggcgtgcagtcaaagtaatcaagagcctctaacttatgagcatcagaaaacagcctaacggaaaatggttgtgtgaatgctacccgaacggacgggatggcaagcgtgtacgcaagcaatttgcgactaaaggcgaggccatagcattcgaaaaccacaccatggatgaggtgaacaaaaaaccgtggctgggggagaaagaagatcggcggcatttgtcagaagtgattgagcagtggcattcactttatgggcagacgctggcagaccccaaacgcctgttggcaaaactcagcattatttgtaatggtttgggcgatcccattgcctcagagttaaccgcaggcgattttacgaaataccgggaagcacggttaaaaggtgaagtaaaaaatgaagatggcgtgcttatgtcgccagttaagccccgtacggtaaaccttgaacaacgtaacctatcatctgtttttggcacactgaaaaagctgggccactggccagcacccaacccgctcgctgggctgccaacattcaaaatcgcagagggcgaactggcgttcctggcaccggaagaaattaaacgtctactggatgcctgtgctgattcgcagagtcccagtttgctgatgattgcaaaaatatgcctggcaactggcgcccgatggagtgaagccgaaaacctgcagggccatcagctatcaaaataccgcatcacttataccaagaccaaaggcaagaaaaaccgaaccgtgccaatatctcaggaactgtatgatgaactccctaaaaacagggggaagttattcacgccatgcagaaaatcctttgagcgtgcagtaaagcgagctggtatcgaactgccagaaggccagtgcactcacgtactgcgccatacattcgccagccattttatgatgaacggcggaaacatactggtactgcgcgatattctgggccatgccgatataaaaatgacgatggtttacgctcactttgcccctgaccacctcgaagatgccgtgacaaaaaacccgcttcacaacctcaattggaagcgctaatttatggcggcattttggcggcagggcattaaaaacgcgtaaaacggacaaatacttaataatactaactcgctgtttttaaacataaaacactgttttaactatactaaaaatggtatgcaggattcatgggaagcagggcgatgcggggcttaagttgcagacgtttgactgtaaactcaccttctgtttctgcaatgacgatgtcaccctgtagcggcttttcggctttatcgaccaccattagatcaccggaatgcagccccatatcccgcatcgaatcaccaatggcccgaacaaagaaagttgaactggggcgacgtatacaatacgcattcagatccagctcttcttctgtatagtcagttgctggagaaggaaaaccggcagcacatctctctgtaaacaaagggattgtcagtgcttcaggaatggatgctatgggaataaagtgcagcatgttatacctcaaaataactgtatgtatatacagtatgcaggtataagtttccacgttcaaatcgatgacaggatttttctgataagtggctgaagcaacgggaattaaagtttactccaaagtagtctttaatactgaacaatgcagagcccacagtactgatataagcgtacgcagataagttttagcgggggataaccggtctgagctaccagaacaccgacgtctcccacaagccctgcacagttaggcggcatactggtcgatatggccgcaaatgaggtcaaaaaagagaaagccaaagtggccttcttcttttccagtccgaccgcgaccgatcagaacctaatgcgggctgacaagttcacttactggcaataaaagtcgccagcattaccttctgaaatttcctcccgcatcacattttttctctcctgtgttttcattacaaaaaacagttgttattattcatgccgtaaatacctttcaactctcaccgaggctttgatgctggagaatgtaatcatcagataatcagttttctgttctgctcagaacggactgattatcgctgcgcttaaactttacgcgaacatctgcggatgttggctcgtttttgctcatgttgattaacaggttttccagtatgaatttatcccgtcaggaacagcgtaccttacatgtgctcgcaaaaggtggacgtattgtgcacgttcgcgatgcttctggtcgcgttacctctgttgaatgctacagccgcgaagggctgttgctcgccgactgtactctcgccgttttcaaaaagctcaaaaccaaaaaactgatcaagtccgtcaacggtcagccttaccgcatcaacaccaccgggctgaacaacgttcgctcacagcccgataaccgttaaggagagcattatggatatcagtactctcatttcttcctccggtcggctgcagctgtctgcagctgaaagtaaaataccctgggaagagctggcgtttagccagcgcatgctggaaaaccatctgtcgcaggatcatgactgggccagccgcagacagatcgtaattgaacagcaggttgggtggattgcccgtcagctactggttggtgcacgcattctggatatcggctgcggcccgggtttatacacccacttgctggcggagcgtggatattgctgtacgggcgttgatttttcaccggcatccatcgagtgggctcgtcagcaggcgcaaaccgccggtctgagcattgactacatccggcaggatattcgcacctactggccggagacacagttcgagttcatcatgatgacgtttggagagctaaatgttttcagtgccactgacgctcagacccttatcagccgctgtgcccggtggctggtaccaggcggcaggctgtttgttgaagttcatacttttgatgaagttaaacgtcagggtatggcgccggcgagctggcagcgttgtccgcacggactgttccttgcggcatctcatctgctgctgacggaaaacgcctgggatgaagaaacgcagaccagctcaacgcagttctgggcgatagatgaaaacggtcgcattagccgttttggcagtcagatgacggcctggcgcgatgacgaatatgccagtttgctcggtaacgcgggcttcaaaatactatcacacccggacagtagcgagtggccggtcagcgagacttttgagggcaagctctttgctctgctggcagaaaaatcaaaatccccggaagggcgttccctgaatacacagctaaaaaaaggagtaaattaatggatattccacgtatttttactatcagcgaaagcgaacaccgcattcataacccgttcacgccggaaaaatacgccacgctgggccgcgtgttgcgcatgaaaccaggcatgagcgttctcgatttgggcagcggctcgggtgagatgctttgcacctgggcacgcgattacggtattaccggtacaggcatcgatatgagcccactttttactgcgcaggccaagttacgagcagaagagctcggtgtcagtgaacgcgttcattttgtgcataatgacgcggcgggttacgtcgcggatgaacaatgtgatatcgcggcctgcgttggcgcaacttggattgcaggcggcgtcgcagggacgatgaaccttctggccatgagtctgaagccaggaggaattatgcttatcggtgaaccatactggcgtcaggtacctccgacggaagagattgctcaggcttgtggcgtctcatccgtggcagacttcctcaccctgcagggccttgtagcctcttttgacgagcggggctatgatctggtggaaatggttctggcagaccaggaaggctgggacagatacgaggcggcgaaatggctaaccatgcgtcgctggctggaggataaccctgatgatgattttgtacaggaagtccgaaaggagctgactgttgcgcccaaacgccatgtcaattacacacgtgaatacttaggctggggtgtctttgcgttaatggcacgctagcgaataaggatccccctggtagattaaagctgccggggggaatatgattcagggaggggcaatgttcaaaaacacgaattgggatagggccctaatataaatgtcaggaatgttttatgagatgcaaggctgacagaagctgaaaaatatataacagagtcaaaggcatggcagacagcctgtttgaggggactcgttgtgctactgatggtgacttgcaacttgcagactgatatctgggttaataccacattttcagctctgaagtacaaattttcatctaccgcaattaaatcgcttattaactatccctacgtataatgtttcgccaaatcccaccggaaagacgcagattttccggatcgctttgcaggatccgggtaacacactgcagataattctccttccaacgttcggtaaatgaaagctggctttcaaatttcagcggatcgaccatcctctcaagcacaaaatggatatgcctgtttttccatatcggaacactgaaaacggtaggcaaatgcattttccaggcaagacgagagcaaaatgtggagtaggtgatttgctgaccgaaaaagtcgatagtcggcgcactcaaattcagcgcgccgtctattgccaccacaagcgactgtccactatgtaaggtctgcatacaggccctgaccacgtccgcttcgcttttatcgctaaccgaaatcaatcgctcgccgtagctccctttgagcacgccaggagtggaagccacccatttgctgttcatctccagtaaggacaggatcatcggcccggcatacattgcgcccagatgagccgatacaataatgcagcctctctgatcgagttgtagccgttggaaaaactgttcgacatgcgatatgtcggccaatcggtacataggttcatcagcctgctctccccgacattcaagccagtcgaggagaaaattatcagcaagatagccccacttcgcccggcgttcccattcgtcgcgctcgataccggactgtctgccggcaacttcccatgcccagtcaaggcgctcaggcggtagattaacggcagatatttgcccatcaagcgccagcagcccctcttcgaatgattgaggcagatgacttgctctggcctgaatatagtgctcaaagacgctttccgtttcgcttgttttccccgcctgtaacaatgccgccgcggcataacggttccatttactcgtcacccctttttcccttgccagttgtacaaactcatcgctggcagcagtgtattgcccaacctggcgcagtgctcgggcatacattgctctgacataaggaagatcaggatgagtcgcgagcgactgctgcagtaacggaatggctttctcattctgatccgttctgattaaggcatcggcatacagggtcacgatacgtacattatcagagttaaattgcagggcatgacgccaatgctcagcggcctgaagcttcgcttcccgactgcgaccggattgatagtaagcaagccccaggctacgacgcagtgctgcaccatccaacccacgggctaatgcggattcccctgtctgaatggcttcctgatatttaccgacagcgcacagcgtatcaaccgccagccccgccgactcctgcctttctaacgcgaagaaagggagcaatgcgcgggccaggtcatgatcttctggtaggcggcttttatttaagaaactgaggcaggtcgcaatcatatctccccgtgggggaacttcctgcgcctgtgttctggccaacgagattgcctgtaactctttatccatcagtaccagtgtgcgcaaatggagggcaaaaatttggctatttcccgaaaaagcgagccatgcctgctcggctaagtcagcaacagtcgcatattgtttactcttaagcagcacgctcgcgaccagcaggacatcctccggctggcacacattcaccgccagcagtttattaactacctgtagtacagcgtccggttgagatgatgccagtggcgaaataacccagcgtcgtaataaatcacggccattctttgccgtcagcacacggtcagacaacaaagtcagcccgacatctgtttcatctttacgcaaacacgcgatagcgaagagaataatgttttgctcatttccagcactatctcgcactttttcgggatgctgactgaaatagaggcatagcccctcccaatcctcttgtttgagtagggtggttggcgatatttttttaaatgtagagtgcaagctcattatatttccttactcagccttattcacgcatccgcctgatggttatcaggagagaagtcaccaggtacgtgatgcccagcaacacgaagaacagtaaccactttgttccatcggcatagtgagtggtgtcagactcagccatcggttgagaaatgatcagcaaatactgtctctcacgtagagcttgaagcttcccttgctgtaaggtctgtaaggcagattcccagcgtgctttggcgatctcgctctgcaggcgaagatcttcaaataaggacaggctttctgaagagccttgcgaccctaacttatttgacaagcggttacgttgttcgccgatctgcttttccagtaccttgattttggccgacaggcgaggaataagggggttctgatccaaaccattcaccattaattgcgcgtattccgctttcgcctccgccaactgcgtttcaaagccagcaattaattgataaatagcggttatggtttccttcgggtcaatatctttttgtatatgctgtatttttagcaattcaagtcgagctgcccccagattctcttgggccgatttaacatcattttccagccacaaaatccgttccttctgcatccgcgctgaaacggtattaacgtgctgttcagcaaaagacagaatgcgctgggcaaaaaactcagcctgtttcgcactccgtgccttcacgtttaaacgcagcatgccctgttgaatatcgacagcaaccgagacttttgataaatagtaacgataaggatcatcattaatacccagcggcgcgtggaagcgggaaaataatgcgatatcgtcttgcgcgaaataagataaaaaaccgagctctttttccatccgatccatcatttctttcgaaagtataaactcgcgaacctgaaagccctccgacatcttattgcctgcaccaaagaaagatgttccagaaaaattatcctggctggcatcagtttgcacaataaaggtggcatccgcactataaaaatgcgatgttaaaatccacgacataagcataataaccagcagcggcaaagcaatataaagaaagagccgacgtagcgattgcttggcttgctgaacacgtcgctctttaataactaatgacgctctacggacagaatcagcatccgtcgcagaccacccggcgtctgggttatgatgactttttgcatcggccgatttttccgtctggcgaagggcgcgttcatcctctttttgttgtagccgcgaggctcggctttcttgtgctaccttcgctctttcttctttccattttttaatacgttctgaattttccacactctatccgtatatttactaattatatatcaaaggaataatcttcagtttgaatcgtcgcctgatttgactgatattgttcaaaaagcgcagttgcctgcgctaaatcttcacacattgtaatttttccatgcagcagtacgccaaacgcatgacagtgttctttaataagccgagggttgtgcgttagcacaatcaaccctttctgttgcagctgacaagctagcgccgcctgcatacgcaactgtgtggcattatccccggtgtacagcttgccatcagcaatataaaggcggcagggaagcagtaaattaatggcaaatgccagatgcgttttcatcgtgacagaatattcactcaccctgtcggtatagcactgttcaagctgggtcaattgataacagaaatgtgaaaactcatcgccatccaggccatatagacttgccatcattcgcgcattctcctcaccggttaaccctggcagaataaaagagtttgcccccagtgggagcgcatcaccccgtagcccaataaaatccccctcatcaggagcatccaggccacacagcaacctggttagcgtcgttttgcctgaaccaggagccgccagaataccgatatgctcatggtagcccatgacaaaatctgttttatcaaggaccacccgcgggcccttatcagactcaaaatagcgtgtacaacctaataaaccgaacacgaatgcgtctctcctgaagctaaagtcagtgattttcagtgtcacaaatcaggtgaaaaatgaggcccgcgaggaataacgttgcggaaaatgccagagggtaaaaaggttcaaggtacaaggagtgatacccctcaaacataccttctctgactatctcattagcatgtagtagagggttccagctgaatatgcttaataatgaataaggcaattcattcgccgtataaaagacagccgaaatcaaaaacatcggtcttagcatcacaggaacagctttgtagaccagcggaaaccgttcagacagtgcgtcacaaaagtaaccaaacgataaccccagaagccatgcgataaccatcccttcaaaaatcaggaacggtttttgggcctcccaacgggagaatataagaaagttaattaatgaaataataatataaatgataactgcattaacaaattcgattgcggcaagagaaaaaatcacatgtcttttcttaacctgcgagacaaccgctaacgatgtagagaatgaatgggttcgcatggttgcggtaatggtataacgaaataacagatacggtaatatccctgcaataacaaaactgatatcgtcagtggatattggcaccgagcgatttaaatattgaaaagaaataacggtaatggatatccataccagtggtacggccagcaccatcatatagtttagtaaattaccgttatagcgtgttttgatatcgcgtgacatcaataaaataattaactcacagacggtaatgagtttcataaaataataagaattatttttcaaaatattcatatggcgacattagaaagaattagtgccgcgggtcaaaaagctatcgaatgcggctttcaccttagcgaaatcagtcaaagaggcgttcgagatatagataacatcgccgttgtccactcgtatggcctgcgctaaaaacaccgagttaggttggctcatatcgacatgatagatattcagcttacgcatctgctgtttcgcctgttccgcttcgttatgcttgtacagaaaaatcgcttgcggatcggcaagattgtcatttaatcctttcgcgagcgccaaagcatccacgacgctggaatgacgctgaaccagagcatgtttcccctgaacacctgctgcgccgagcacattaacatactcggtcacttgacgcagagtgatacggtcatccggctgtaaggcaatatccaatccgggatactgataaatatctgacagtcgcgcagtgaaataatgctgctggcgcgtcacgtgaacttccatcatatctgtgctggtattttctactgccactgccgttgccaaaagatgactcagacgattcatactctgttcgagagggtatcgacccgttttcccgctgccctcgaccgtcaccatggctccggtgcgggcggtaagtgtcacaatcacctgaggattcaggacaacgcgcgaaagtcgctttttgatctcatcagccagttgcgtcacatccaatccagaaaccgggattgtcccggcataaggcacctgaacggtattactgtcagtcacaagaatattttcaaaatccgcacggtcgccgctcgcgttattggataaatatccagccccgcccgaggataaaatagtgatatgcagcacatcgcctttagccaaagatgtccagtgccagttatttgcggcaaaaaccggatcgacaatagttttcggcacagtatcgggagcgcttagttttaatgtcggcgtgacttcgaccagattataacgaggatcgtcctgattaataaggctggatttaaataccgccctgggaatagtgcatcccgaaagcaggaaaaatgtcgttagtaatatgatgatttttttcataacttattttataaatgaaatagctgaaaaatgatgcccattaaatgcatatatgaatatcctccttagttcctattccgaagttcctattctctagaaagtataggaacttcgaagcagctccagcctacaccccgggctcgagctggttaatttacggggtgattaccagaccaatcgccagtggcgcaaagcccgcaggagcgcgtttttctgtcgctccggacaaaaaacgcactgaggacaaactcgctcagcatacaggcgcttaacgcatagccgccaggtgaatggaggccataaccattagccgcaaaaccgctggttgtcgcatcaaacccagccttaccgctggcgataccatacagcactgccgcagcggcaataccgccgataacctgagcgataatgtaaggtaacacgcgcgctgcagggaagcgtccaccggcccacagacccaaggtcaccgcggggttaaaatgcgcaccagagatgtgcccgaccgcataagccatggtgactactgtcagaccaaacgccaacgccacgcccaaaaagcctatacctaactgtgggaaagcagcagagatcaaggcgctaccacagccacccagaaccagccagaaagtgccgaaaaattcggcgctaaaaggtttaaacatacactgatgtcctgtttgttaaagagcaggcatcagggtaaaggcggtcacgatgtaccgcctagcggggatttgtaagagaggtgaagaattggtgtggaaggttaaacctaagcaatcacaggcgaatgacattgctcgcttgtgataacagcgattttttctgctgccaaactagatcgcaaatatcatcagttggattgaatgccgctggtgcttgtaacaacaaactgcgaattcgctcatgatcaaagtcatgacaagcttgatccagctctttaagtaagagcgatagatcctgccacggtagcatcacttcgttggccgtcataattcgtggatgagaggtaccttgaactgaatcaccaatcagtaattcttcatacagtttctcacctggacgtaatcccgtaacttcaatggcaatatcgccatctggatttttatcatcccgtacactcaagccacttaaccggatcatgcgtttggctaagtcataaatcttgaccggatcgcccatgtctaagacaaagacatcgccgccatgccccatcgcccccgcttgaatcaccaactgtgatgcttccggaattgtcatgaaatagcgaataatgtcacgatgagtcaaggtaactggcccaccttgggcaatctgtttttcaaacaacggcacgacagagcccgaagaaccgagtacattaccaaatcgcaccatacaaaagcgagtttggctttgccgtgcagacaaagcctgcaataccaattcggccagacgcttagttgtccccatagtgttggtcgggcgcaccgctttatcggtggaaatcaacacaaaagtttcaacgccactttcgatcgctgactcagcgcagtacaaggtaccaaacacgttattacgtaccccttccaccacattatgctcaaccagaggcacatgtttataagcggccgcatgataaaccgtttgaataccaaaggacttcatcaccatctgtaagcgattctgacgctgcaccgagcccaacagagggatcactggaacattcaaaacttctttgtcacacagcgccgagagctctttctcaatagcgtagagggcatattcagacagttcaaatagaaccaatttggccggcttatatcgaacaatttgacgacaaagctcagagccgatcgagcctcccgccccagtgaccataacggctttgccagtaatgttttcggccatcaatttggcatcaggagcaaccggatcacgacctagtaagtcatcaatcgatactttttttagattactgatttgtgctcgaccttcgactaaatcgaccatacccggaatagagagaacttcacacggtagatgctctaaacgagtaatcactttctgcctttgtgacttactgacgctcggcatcgccaaaagaattttctttataccatagcgatctacaaggtaactcagtttatccgagggataaactgttacaccatgaatgacagccttatgcaagcgaggattatcatccacaaatgccacaggaaaatattcttttgcctgcattaatgctggcaataattgtcggccagattcaccagcgccataaatcaaaacaggcgcactacccttaactccatagttaagtatcattctaaaaagcaatctagagcctgatgtcagtaaaagtaaaaccaaaaaataaattccgacaacagtgcgcggcaacattatggatagcgaatatgatataacgacaagagataacgttgaggccagaataccaactggtattagcaacattatctttgcactaacataccgtaagactgcccgataaagcccaatcctgataaatataaacacggtaaatatggtaagaatagctgcagcaaaccacatcggtgcactaagaaaagccgtttgctcatcaagcctcaaccaataagacaaccaaaatgagaatatcaccataactacatcaatgcagatgatgatacctctcttaacaattcttggcagctccaatattctatcaatcatcctacactaccttattatcgcgacaaaatcttaataatagttttccaaattatcacacaatcatactttactgaattgttagcaacataatctaaataatatctttgcttgattggaagaattatatctatataagccctacgtgggtcatcataactagacaaaatctcattttcatctaccatttctatagatgctaagtcagttatccctggcctaaccgataaaactttttcccttatatcatcaggatactcatcaataaactccctcacttccggtcttgggccaaccaaactcattgttccagaaagaacatctatcaattgaggaagctcatcgattttgtacttccgtaaataccatccaactctggttacccgagcatcttgaccaactgttatccgtccttttttttctgaatcgataaacatcgttctaaatttatgtatcctaaaatctttcccaaatctcccaactctatactgcctaaaaaaaaccccccctttagaatcagcaacaattaacattgacacaatgataaaaacaggaaatagaaaaagcaggcctaagcctgccacgataacatcaaaaatacgtttcatttaatataaaataccattacataaataattgtctaatcgatttgataacgaacaactgatcttgatccgtcattttagtataaagaggaatagatatttcatttaaataacactcctcagaaactggaaagtcactggcgttcaaattatatgtatcacgccaaaccggttgcttatgcaacggtataaaatggacagaacaaccaattccaagatctgataacttcttaataaaatcatcgcgattaatagccgaatcagtttttaagcggataggatatagatgccaagcatgaatatcactagcattagtaggccattcaggcaattcaagtggcaattcttttaacgcatcatcgtaaatttttgccattcgttgacgttttttctgaaaatcatcgatctttctaagttgatgaataccgattgccgcacagatatcaggcatattgtatttaaaccctggagctacaacctcataaaaccaagaaggagttttagactggtaccggtcaaaagcgtcacgactgattccatgtaaacgcattaccttacaacgctcaattatatctttattttttgaaacaaccattccgccttcaccggttgtcatagttttattggcgtagaagctaaaaaccgtagcatctgaatcaagcgttcctatcttacttcctttatatgttgtaggaaatgcatgagcggcatcctcgacaacctttaggtcatattttttagcaattgataagattgaatccatgtcacaagctaatccagcgaagtgtactggaataatcgcctttgtttcattagtaatagccttctcaatggcatcaactgatatattaaatgttttacgatctacatcaacaattacaggatcagcaccaaggtacctgacaatttcggcagtagcagtgaatgtatatgatgggacaataacttggtctcccggctttacgccaacagcttcaagagccaaatgtaagcccgacgtagcagagttaacagctaatgattgaacgttcgctcctaggtaattagaaaattcttgttcaaattgcttagccttaggacctgtcgtaatccaacctgaacgtaaagagtcaattacctctgcaatttcttcttcgccaatttcaggtaacgcaaaaggaataaaatttttcatttaaaataccttttcaaaaaagataataacgatccacatccataagaaatatgataagacaaaaatataaaaggaagaaatactctacctataaaacttcgcccatctcgaattgaaaacaaaatagaaataagaaaataaaaaaataaaaaagataaatatatataatcaccagtagcaaagaaaagagaaaaagatacaattaaatacaaaacaaaaaaaagtggcactatatgtctaaaataatatgctccagacataacaacccaaaaaccatcaagaaaacctttctttatgaaatctttaaaattatctctaacataatactcaacaaataaactattatctgtatataatgacaaattattgcttaaaactctcttatgaaaatcaatatcttgatttctatctaatacttcattaaaaagtccaacatcaaaaaacacatctttattatataaagcaaagacagccgtatctgttttttttagtcgattatttttgtctacgcacctaaatggagaattaccaacaccaaatttcgatgcataaaaatccgctacaattgaaccaaacttagttttataagaattagttaatacacctccaacaccaacaacgctatcatcaaactgcataatattaaaataatcatctaataatttagatatatagttatttggaatatcactatgtgcatcaactctacacacaaacttaccattagcttctagcaccccaatattccaacccgtagcaagagttctttttttattattgataattttatgcttaatgttgctatgtttagaaaaaacatcctgaacaatagatattgtattatcagatgaatccccatctacaataatcaattcaaatttatctaatccaacatcttgattaataaatgccaaaagagatttttcaatatacttctctgcattaaagcaaactataattaaagatactagaacatcactcacaaataccactcctcataaaatatagttttcttttccctgagtgaactgaatcaacaaacaaaaatctattatcaaccgagatccttggatgtaagtcacatcgagaataagaaaaaaaactcattgactcataaaataatccaagctcgcgataatcatttttgacaaggtcataaacaaacaactttttaattctatttttatctgggtaagtatcagatataatatatctattatgaactatagtaggatgtccatcagaatattttcttgcatcaaaaaacaatttctctgtattacaggattcaattgacaatctataataatttagcgaatctatttctgcaccaaaaaaacctataatttcatcattcccattccaacaacaatgactaataatcgattcatttattaggactcgaacattatcatttattaaattccaatgtattaacctttcacgctttcctttaggtgtatagtatcgatgtatgaacataacggaacgtccatcgggagcaaacataaaatgattgaccacatgttcaacatcaatattacatttaaaattagttctctttagcatttcgtctaaggataaaaataattctattccccccgtgttcaaattaatgattgaaatatctgtagaaaatgattttttattataataaccataatcgctatcatatttagccagccatgagaaatctaacgtcacagccttgtaattattcacatcataaatcggatagtttattttttttataaccttcatcaaagacaaagaatagacaacactaatgtatccattattttcatagtcattaaaaattatattgtcatcatcaatccacattaatcggcttccctgctgccaattaaatgctcgcgtatcatatagcttataaactttgttattaagaaggtcttttacgcaaatagatatatacttaactttctttggatgtcgtttagtgctaaacgcactagagtggaacaatacgtaccgcccattagagctcattggactatggtcataatagccaaaaaatgattcttcagaatcatcaattgaaatctcgtatatttttgattgaataaccgtcttatttttattcaaaataattccgaataatgatgcgatatataaataaaagaacttaataacatcccttaccttaggatacttactcaaggctaaggaaatttttctttcaacatattctaacaacatattctcatcctaaatagctgcgcttggatccattgctcagtccggttggtgatttgttttgatttggcgattgatcagatcgcacaatccgggctaagttccctcaaagtgatctactattccgcgcagctatttagaattacgtataaaaaccaccgataaaaaaatagaaatataaatatatatcgctggcgtcaatatatactcattaaaaaagacatagaaagccaaagcaaaaacgcatcctttaccaatataccctccgcatttaaaaattggagacagcattatataaaatacagaaataagcaaaataaaaccaataatccctaactgagccgaataagataaataaaaattatgcgccaacccaaagttggtacttcctaaaaactttttatctatagcctttacataatttgcaacacctaatccagtgccaattaaataattttcttttaaaacatcaaccccaataaatactaactcaactcgacgataatcattctgactttttgtaagagtgttaccaccagagaatataacctgtgacgaagacagcattcgttcaagacgagtgcctatatcagtaaaagaaatacctaaagttagaagaggaacaaaaaacaatgatattaataacttttccttctttgttaactgaagaaaaacaaaaaacaacgatatagcaaatgatattattcctgctcggctatccagaaaaagaaagaacagagagtacaatacagatgagacataccaagactttcgaccacgataaaagtatgaatatacacaataaaagcacactactataattgcggtggcatttctatttaaataaactataaaattactatcttcagaataaccaataaataattttacaactccacagataataccaaaacacattacaacatttatatttctaaccgaatgagttaaataaagctcatctttaccaatgcaaaatgacaccaaaagaaccaaagctataaaattagaaaaaaacgataataaaattacgacacctgatatatccgctgataacaacaacatctgaatgctgatataaatcaggaatatgatgcctaaaaataataatttctttgtccacagagaaacgtgaaacctcaacgttattatagatgttaaaacaacaaagaaataaaatattagatctggaatatagccaataggaactccaaaaaaacgctctaaatcagagttcatttgtccataaaaaaaaaccggaaggatattaaataacaaaagtacaggatataggtatattaacatacttaacctttattaggcttccaatcgagtctaaacatattaatggaacgatataaaaccacaacatattaatataacaaccgctgctgaccattaataataaaataaaagaaaattgggacaaagatcatcattagtgaatacttatcatgaagaattttcccacaatcttttttcacagaaataatataaaatattccaattactaatgttgcaatggcacttccaaaaaccgccccactccatccataccgaggtataaaataaaagaaaaccgccattgaaatgaccacaccaatacaatacgatttaactcgctcgctttgatttccactacacacaagataaagttcatttattagccaaaaattatatttaataagagccataaacattatcaaaaatgttgcagaagatattaccttatactcatcaccaaacaatatccctacgaaatagatgccaaaaaaataatagcataaacatagtaataagactaacagtgatatatatcgttgtaatttccttatattaccccattcagaatttttcagataataagaaaatgaaggcaataaaacagtataaataacattaaacactattattagaccggtattaaccctagttaccacctgatatatagcaacactattataagagaaatattcttttaatataaaaaggtcaatactagataaaacaacatttagtaacaccagaatagcgaacggagttgcatccaaaaaatctttataaactaaaatacttggtctttttatatgaaaacatggcacattgcatttatgtgatgagaaaaccaaaagcgaaattgagtatatgaatattgatatcgcactataatatagaggttcgataaacagagataaaaataaattacacccaatatatataattgttgagtagatatttatatataattcacatctaaaccgaccaacagcctgtagcaagctaaatctaccacttgaaatacaaacaaaatatgcagatgaaatataaacaagcagagttaatgaaattgaatcagaaacataagaataaaacatgaagattataaaaatgaagaaaaaaacatatgttttaactccatcacttcttgataataattctgatgcagaataactattatcagaaatatctttcactaattttgttctaaatccataatcagagaagttaagcacaaaccaataaacagtaaacacataactaataataccaaatgtagtaatatctgacacatgtgtgaaataaacaaaaactcctatttgaaatattgctttaagtaaaaatgtaccacctgcatcaatcatttttctaaacatacactgaccatttagaataaatacatggattttcacccctgcattaataacagaggtgaaatagattatttattcatgttaatataatttagccttttaaaaatctcacataccacggcattgaaagtcgtaatccctctctgatttttatatttggtctatactttagtaaatctatagccttagtaacatcagcctgagaatgcctaacatctccagatctaaactctctatacttaatgctcaatttatcgatatggtgaattaaattaagctcatcataaatgtaaccagataattcatttaacgttgttctatcaccaactgcaacattatatatattatctttagcactgtccttcgctaatgcagataatatattcatttgtataacattatctatataacaaaaatcacgactcgtttcaccatcgccattaatatatacgtcatcacctttaagcattgctgctgtccattttggaattactgcagcataagctccattaggatcttgacgacgaccaaatacattaaaataacgtaatccaatagttttaaaaccatatgttcgagcatatacctgagcataaatctcgttaacatatttagtaactgcataaggagaaagtggattaccaatgttttcctctacttttggtagtgcgggatgatctccataagttgagcttgatgcagcataagtaaaactttgtacttgtgcatttttagccgcatgtaagatattcaaaaatccagtaatattagttgcattggttgttataggatcaacaattgaacgaggtacagaacctagcgcagcctgatgtaagacatgatcaacacctttcataacttgctcacaggtagtgagatctcgaatatcaccttctataaagcaaaatcgactccactgttcagtggaaactaatgttttaacttcatcaagattatattgatgtcccgtggaaaagttatctaacccaataacaacctggtttaatttaagtaacttttctaaaagatttgatcctataaagccagcgacaccagtaattaaccaagttttcggtgaaaaaattaactgctgtgtaatctcttcatagcgagacatataaatatccatgtatattaatcaagtgctaaacctagcataaaatgctgaggtgtatcatatcaaagaggatttgatttttttaatcactcttacaagcgcatatcgatactttttttatcaagcacatattttaaatcgaacaaaacgtgctcgtctttacctaatgcacgaatagcgctctctcccatctcgcgaaactcattgtgtgcaacagcgataattattgcatcataatgattaactttaggatcttcacataaagttaatccatattcatgttgtgcctcatcggtagaacaccatggatctataatatctatattgatattgtattcttttaactctgaaataatatcaatcactttagtgtttcgtagatctgggcaattctctttaaatgtaagccccatcactaacacattcgccccttcaacttgaatccgttgtttcaacatttttttgactaactgggaaacgacatactgccccatactatcatttaaacgacgtccggctaaaatcatctccggatgatagccgacactttgcgctttatgtgtaagataataaggatctacacctatacagtggccacctactaaaccgggcctaaaaggtaaaaaattccacttcgtacctgcagcctcaagaacctctaaggtatcaatccctaacttattaaatataatagataactcattaatcaatgcaatattgacatctcgctgcgtgttttcaattacttttgcagcctctgctacttttatcgatgatgctttatgcgtaccgacagtaattattaatttatatagctgatctacatactcagcaacatccggtgtagatccactggtcaccttaaggatattagttacacgatgctctttatccccaggattaatacgctcaggtgaataaccggcaaaaaaatcaatattaaacttaagacctgatactttctctacaactggtatacaatcttcttctgtcgctccagggtaaactgttgactcataaataataacatcgcctttctttattatcttacccaatgtttcagatgctttaattagaggtgttagatctggctgtttatgtttatcaattggagttggaacagttacaataaatacattacactcttttagtgcatctaatgaacaggcgtacgtcaatttagttgcttctaacaactctaaatttgagcactctaatgtactatcgtgaccatttcgtaattcatcaatacgagacttattaatatcaaatccaatcgtcgttactttctttccaaactcaacagcaagaggcaatccaacataaccaaggcctataatcccaattttcgcattcaaagtatcgaatttcattttcttatccatcataaagtgcacatagaacatctatttcgcattgacacaacaatacgtaacccagtttaatctaacttggttttatcttttaatgtcgcataaactaatgtaccaactatagcaaacattgcccctggtaatgcaccaagaatcaaaattaatgctttgttgggtttgtcttttataactggctcagatggcttcatttgatatcgatatgcttgcgcctgaatgttatcgcgtaacattccttctaactcatcaatttgacgtttcacttcgtaatatctaaatgggtaaataattggcgcatctttagttgcttttagctctgctgataacagtttttcgccgagcaagaacttatagctactttgcgcattatcgaagccgcctttgctagagcgataatcaatgattccggcttgttccgcagttgttaaatctcgctgaatatgagctatttgatcaagcttttctgattttctctggaaatctatgtcaataatttctttatttagattaaccaaaagagtattaacattttgaccaaactcatcaagacttaatgttacagcttgattattaacattctttagatatccctgcagtagtttatatgcctcttgcgctgagtctgccgatgcttgtattatgtagtaacttgtatttcccttttcctttggtggcgtaatcacaagacctttattcgcttgctcagctaaccaaattttcttatcttgttcagtagataaattatttgtttcctttttataatactcagtactctctagaaatttaactttggtgtctggcgattcagcaatcaaaatcaaatcggaaaacaatccattagccaacgcattcgtatctaacggttgatttaatattcgggcatacgcttggtgaaatttaagatagctgcctaattcagcaatacgtggtgcttgaatataggttttagccgtccactgctcttttgcggtaaaggcatacactgctgctaaccccgtagtcagcaacgtgacacataaaataacccattttttcttccacaaggtgcctaaaagctcgaaaagatcgatttcatcctctgcttttggcatataagttggatagaccccttgcgggatcagataaggggtctgttgtggttcagatgcttttgacatgaaaccaatccattatttatcaatgggttaaaaataaaaatgaagaataagcctgacaaaaaagtacgctaccgcccttgagtttcagctcccaaagcgcgtcgaggtttaaactactaggattagtgtttcttgtcattcatcacaatatagtgtggtgaacgtgcacgcgggtgcaggaagaagtgaccttttggtgcgttctgactgttgattggctccagagtgacgccggtattcgctttgcctttacgatcatgaacagcatagagaataaagggcagggcaagtaccaccaggaaactaacaaccagtaattcaacatacatatcggtagaatcaccctggatgttatccggcggcaggaaggaaacaataaacgccataattgaagtcagcagaccgacaattgccacgaccagtttcacccctttaccaccagggatattaaatgtgcgttttaagtcaggatgtttaagaaccaacacaatgtagccaataaacagcatgaaataagcacacagataaatcaccaccgtcagcgccagtgcgatcaggaaggacatgttgttaccgccaccggtattggtgaggatgatcaacgcgatagaagtaatcaccagctgcgaaatgaccagcgttaccggtacgccatttttgttcattttagcgaatgccgctggcagcaggtttttctgcgctgtgacatacatcccgcgagaaggaccaacaatccaggaggcgatttccgccagaacacccagcaacagcagtgcggagatcacgcgaaccgtccactcaatttccggtgccacatgggacatcagaacggtaaaggtttgcattacccctgcggagaggttgatttcattacccggaatgaccatcgcaatagacaaaccgccaacagagcttaagcagattgccgccaccatcagcagtaacatagccagtggatagtcgcgcccggggttgctcatttcattgacgtgagttgcggaagcttctacgcccatataactcaaaatgaaggcaacaaatacaaccagtgtgcccactttagagaagtcagggaagaaggtcttcgaatccatttcgatagcaacgggggcaccggagtgcaggtaaatagccgctaatgcgatcaaaataaatgcaggtaacaggataccggcgaagaagccaactttagcaattcgcgccgtgtatttcgtgccaccaaactgcgttaatgccagcgcccaaagaatgatgagtgctgcaatagttttggtaatggggtcttcattcagcgctggccatttcaggatgtaggagagtgcccctaacacgaaatagagcatcggaataaaaccaatggcgatttgcagatagccaaatgagatcgctgcaaatccccatctcggacccagagtatttgatacccaggcgaagacaccaccttcttcccagccgtcgacggtggccatttccgcagcacaaagtcccacgggaataaaccataaaatcccgcctaatagcaggaagaagactaatgaaaagcccgatgttgcgaaggtagggtattcataaacagccattaccatcgatgccgttatggcaaagaatccgagtaatgtgagctgcttagctttacctgtctgtactgatgtagccatattatcactccaaaacggttatcaggtatgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgaccggtacagatgaactcatacggccccagtttggcgatctcatccgccagataggcagcgacctggtaggaagcattctgtactttggtatagccttcacgaccaaggcgcaggaattcatagtactgtgcaatcacctgacccgccgggcgggagaagttgatggcaaaagtaccaatctgaccaccgaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccagaaagccaccgctggcggcgtcgatgtgcatgtcgatgtcgataccggtgtcggcctggaatttatccagtgcatcgtgcagcggttgcgggaactcatagttaccggtgtaggtcacgccgaaagtcggcaccacgccgatggtattttcgtcgcaggcttcaatcatgcgtttcgggtccataaacaactgaccggggcgcatagggatctcacgcagctccacatcccagtagcgggcgaatttatgccagcagatttgcaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatgtttacgcaacgcaggtcgatggctgcggattgcggatattcttctttgtcgatccagtttttgttaatggataaatccatcaacttgtggacgttttcgtcgtcccaggtctggcagaaagtggccaggttctgacgagcgttgccatcaagatataattcatcattgataatctgaaatgcgacatcgtcgcgcatttcgtgcagcggaaaacgttttgattctgcgatagtggaaatagacttcgcaccaaaacgtgaatcgagtagttccgaccttaaatccgttacttgcttcttatccattttaaactccttaaaatgattggatcgcattaaaacactccaagtaggtcaggtgtgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgacccgtacagatgaactcatacggcccctgtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtgtcggcctggaatttatccagcgcatcgtgcagcggttgtgggaactcatagttaccggtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacactaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttattgatcgacaaatccatcaatttatggacgttttcgtcgtcccaggtctggcagaaagtggctaggttctgacgagcgttgccatcaagatataattcatcattgataatctggaatgcgacatcatcgcgcatttcgtgcagcggaaatcgttttgactccgcgatagtagaaatggcctttgcgccaaaacgtgaatcgagtagttctgagcggaaatccgttaacagcttctggtccatcgtttcactccatccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggtttggttagcgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaatgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtttgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacggggttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgtatcagccaggcgaagctgcttttgagcaccacccggatgcctatcgccaccgtcggtcgcaatgttggttttgacgatcaactctacttctcgcgggtatttaaaaaatgcaccggggccagcccgagcgagttccgtgccggttgtgaagaaaaagtgaatgatgtagccgtcaagttgtcataataaatcgaagcagctccagcctacaccccgggtacgacttccctgatgtatttttttgtaatgcggttatgcaggtcgagatctgccttgtcaccggctccgttggtccattcactttctccagtcgctgccaatactgcaaagcctgcgtgtagtcgcgtaaatgcattgcatttaatgcggcatatttcaaggcataggcattttcgctatcaaaaacgagtaattttttcgcatagtctagatgttcataagacgtgatagtgctaccgccatccttccgtgactcattaaataatctgataatttgcttatattcacgcatcagacgagaaacatcaggctcaattcgtttcaggctaatcaatacagacaatgcttcatccagacgcccttcagttttcttctggcgtacatatttaagggctctggttgcaacattgcgacactctttctcaaacaacttgttcattgaggcattctggaatgatagagtaatgctcatgacgttagcaatcaaatcaatgaggaacggaatgttgttaatatgacgtatgctgcgtaacataatcgactgcaggctggtaatgttcgagttacgaatcaaggtcatgtgggccaacgtgcacgcgtctttccaggcaccaagattcaccagcgttcttgcacaatatacggtgccaacgggatcaaacttcagaagtggccacactattttcgcccctgccaggatattttcataatcctcacgctcatacatttctcttaatttatcgcgccatgccattttaacttcattattaaagcgagaaatacgtgaatggggataaaccataaatgcagagtagctataggctagcgaagtactcagtgagacaaaatcatcaaccgaatgtagcgacagcgcggtattgttccatgcctcaaaaacgtcgtggattttatctttatacgaggtgcgaagcgcttgatgatagctcatattcttgatgcagaaagctgtgcggataacgagaccggtatcatgaatcgtcgacaataccgtcagcgcaaattctgactcatggcggagtagctgctcgagcgcatgcatgaaaatcaattcatcactgaatttgattgccaaagataacgccgtttccataaacgtatcatttaggcgctgcgattgaatgccggcatggaaagcttcagagaatgcgttgccatcattgaaatattgcgtgctgctcaggaaattaacccatccgctttgagtttcaggattcaataatagtacacgtttccaataatgatatgacttatcaaacagctgtaaagcatcggctgagccggcggcaacggtaaggacttcttcatcttcaatttcattggaaagcatcatctctgccgtcgataaggcttcccgccaacgcgctaatccatgtagagacctcagccgacaacgtaatgtactgtcagtcgtaccgataattttctcaacatcactaatatcctgataagcctgttcataataacctaaatggctgaagattacggaccgaagttggattagaacgggatcttgctgctgatttcttaatgcggcaaaaagttgttgtgatgcagcaataatgtcgccatctgcaagctgcttagtgatcgataaggtaatctcacgtatttggtcctgtttctcttgtcgcccctcatcaagatgatgattagtattattgatcactcccttaaaaatagccgcaacgatcgcgtcaccaaacatatcggtataatgagtaagatcgtcgccatttttttccagggctcgtttctgcccccacttttccatcaaatttgtcgggttaacgcagggaatatccatcctggcggcgatggtgtcgacatttttaatcaaccgactacgggatagaatgacggttccagcacgagtcacggcatcaacatgtgtcataaacataacgcgatcgcgaccaagaagctgaacgatttccatcatatcctgttcgatagcatgctcatccatctgctcgacattgatattgcttaataaggcacgatcgtcttccgacattccggcaaaacagggatcgtctttgagataggccagcagtttgtgtcgatttccttgcgtggccaacgaccagtacatgcacgcccgctctgtttggctaaaaaattcatagaaatgacgagttaaataatttatttgtaagcagaacccataggccataatcttcttctgacttgaaatctcaatgatatagaaatcagaacgactatgtacgtcggtgtttgaatagtttacattaggtctaaaaataaatggtcggaccttttcaggaatgtctatcaagcccaaaataaaccgaatctgctgtaatgcctcgctgctcgtatgcgtaaaaccatatattctcttaaagtttgcctgaaaattaaaataaggctgagctcgttttaccggactcacaatacggcaactgccaatggctgtaagcgtaaacatccctgacgatttcattaaattcatccacgtgaaaggaaagtgagtagttataccgaggaatacaaagtagaatgtttatcgatataccattttagagtttgcttaagtccttctttgatatcaaattcaggctcatatgaaagaaatgtttttattttggtaatatctgcctggctatgcttaacgtcaccgtcacgaaaatctttataaattggttcagctctactttgttcgttccgccataaattaagcccatcgcgaattagataataaagctcatttaacgaagttctatctccaactgccacattatagaccttatttttagaggctaaatcattagttgttgctgataatagattggcctgaatcacattctctatatagcaaaaatccctgcttgttgagccatcgccattgatataaattggttcatctttaagaagcgatagtatccagcgaggaataactgccgagtacgctccgttaggattttggcggcgaccaaagacattaaagtagcgtaggccaatagcgttaaattcatagctacgtgcaaacacatcagcgtacaattcattgacgtattttgttaccgcatacgggctgagtggtcgaccgatccgttcctcaattttaggtaaatcgggatggtctccataggtgctactgcttgcggcgtaggtgaaactagagacatgagcatctctcgccgccgtcaacatatttaaaaaaccatcaatattggcgctattagtcgcgatgggatcctttagggaacgtggcacgcttcctagcgcggcttggtggagaacatagtcaacgttcttacacgctttctgacagtcagtaaatttcctgatgtcaccctgaataaaaataaatcgcgaccattgctcctcactgacggacgtgcgaacgtcgtctagattatgctgataaccggtggaaaagttatccagtccaatgacagtctggttgagaaagagtaattcttctaataagccggagccaataaagcctgctacgccagtgatcagccagcgctttggtgccagaaccagtttggtccgtagttcttcgtaagccgtcatgattacaatctcacatctgactgctcagccggaagaacatacttcaaatcataaagtacatgtttatcttttccgaagccgcgaatatcctcacttcccatctgtttaaattgctgatgtcctactgcaacaatgatcgcatcgtagtggcttgatttgacttccgataccgggataatgccatactctcgtcttacctcttcggcatccacccatggatcaaaaatatccactttacaactatatttaccgagttcctttaccacatcaataatgcgtgtatttctgatgtccggacagttttctttaaaggtaaagccgagaatcagcacgctggaaccctcaacgttaattccttttttgatcattgctttgatcaactgctcggagacatagttgcccatgttgtcgttcaggcggcgtcctgcaagtatgatttctggataatagccaatgccctgagatttatgtgtcagataatagggatctacgccaatacagtgaccaccgaccagtcccggacggaatggcaggaaattccatttgctgccagcggcacgtagcacggcttcagtatcgatatttaaacgattaaaaataatcgccagctcattgaccaaggcaatattcagatcgcgttgcgtattttcaatcaccttcgctgcctcagcaactttgatgctctctgctttatatgtacctgcgctgatgatctgctgatatacttcatcgataagttcggcgatctgtgcggttgaaccggaggtgattttcttgatgttggttaaacggtgctttttatcaccgggattgatcctttccgggctataaccgacatagaaatcctggttgaaagtcattccggacatacgagcaaggatcggcacgcattcttcttcggtacatcccggatataccgtagattcatataccacaatatctccccgattcagcactgtaccaacggtttcactcgccttgattagtggggtgaggtctggttgcttgtaggtatttatcggcgtcgggacggtgatgatgtaaaaattacattctttgatcttctcaatctcggaagtaaatttcagataacgagcctcacgtaattcttcttcagtggtttccagattgacatccaccccattctttaattcaagaatacgctttttattaacgtcgaagccaacaacctgacgagatttgccaaattcaactgccagaggaagcccaacatatcccagcccaataatcgcgatttttacctcgtctataccgaacactcttattaatcctttactaaaattttatatttacaaagttaattctaggtgtttattcagatacgctaccgcccctggccgtagcagccagtatggttaatgaaaacgtataaccgtacccctttcttacttgaatagaacagaagtcgctgagaatatatgtattaacgccaatgagtaacgaaaataattttgtgctgaaacgaaatacttgtccgtgttttactcaataaaaattaccgcattacagtaaagtaactgaatccggcaataacagatagcgcggctcacgtactccaaattttactgccaattcttttctccagcgatacatagtcgatgatgagttcataaatctatcctgaagctcttccataccactttccgaaaggaaatatttcatctttactatatccttacggttaattctgaaacgataatctctctgctccgtcaagatcttttcaccactttggtgttgactgacatttctgataatatcctggactgatgttgccgcatcgaaaacagcaataacatttttgcactctgtcaaccaaaaacgtgcaaggggcattagtcgcgaacttgaaatgataacgattattttattaatatcactcattcgcgtgaaaaaattcagggcatttaacaggctgtagcgatttaggttcacaaacaaataatttctgtcatttgttatcagtgacacttcttcaataatgccagcagctccaaccccgaaatagatatcattcggaggccagaaatgatgaaacctcatgaagtctccttatgctgaaataacctaatttcatccatagaaaaggtacaagcaatatctaattctttgctcctgttaacaattaactaacaataaaattattaccctaattttaatagtactaacggcctaaacgggatttttacacaacagagaattgatgtcaaacctgcacaattcattgtttgtacctatcaaaaaatcttatttagtctagaaaatcgaatgataaattatgctaaattgtttggatagggcgtattttttaatcctggcgaccataaaaaatgctaagccattcctcaaaataagaatattcctaatcgtatttgaaataatctgttacaaatttaattgtttgcacctttggggttaaaccttaactgtacagaatcacaggctgtattttaattactctttgccctgtttccatttcaaattaaagatatggataatgactattgttagttaacttttccgttgacgatgtctacaaaatattttctcgctagatgtttgcattagagtcacccattaataatgaccggaaaaccgtcagaacgtcatactggttttataatttccggtgaaatgatggtgcgtgactgcttcggaaatgaataccttattcatgccggcgaagcatttgaggtttctgagaatcatgatgcctgggtagtgggtgatactccgtgtgttgcgctggatttcacgcatttcctccgctgaggatatgaacttgatggtacagggctggtttgcagaattcttttttttggatttataaattgcactggataacagtctggcgggttctcaggatgagcaaaatgcttttatccggagcccgattatgccccacactgatactcctgaacaggctgctgtcatcgcatggaagggcgaacgtctggttgtctgtgcttttgccgggagtggcaaaaccaccacacttcgtcgttatgctgaggaaaatccaacggaacgaatgctctatattgcttataaccgtgccattcgggatgaggcggagcagaaattccccttcaacgttacctgcaaaacatcgcatcaactggcctggccgacggtcgggaaacattacagtcatcgtctgattaattcactacgactgacctatgtcgcccgggcgctaaactcccgcaactggttgctggccagactgacgcttgatgttctgaatcgctttatatgcagcgcggccaccgatattacgcctgaacacatgcctgatcctgacgactgtaaggggctacaaccaggtcaaatcctgttttcagcaaagaaaatctgggcaatgatgtcggcccgtcagggggattttccggtcacccatgatacttatctaaagctttaccagttgagcaaaccgaatctttcttcccgctataccacgttattgtttgatgaagctcaggatgccaatcctgttatcagcgccattgtgctcaaccagacctgccgggtagttctggttggagatactcatcagcaaatctaccgctttcgtggggcggataatgccatgcaggctccgcaactggagaactcagaccgtctttggctaacccacagctttcgcttcggtccggaggtagccggggtggccaacaggctgctggccctgaagggcgaaacgcatcagataactggaaaggggggcgcaggccgtgttctgctcacaatgccgcggaattttggccatcatgctgttcttcaccgatctgtctgtggtgtcatccggacggcactgcactggtcgctggctggcaggaaagtattctgggttggtggtatggaaagctacagaattgaggatttactggatctgtactggttctcaattgatatgtcggagcgtatgcgacacgacaggctgacccgtgaataccgggactatgatgaatatctgcagatagccgaagataccggtgatgtggagatgaagcaggggatatttattcttgaacagttttttccgttaccggacagactgaatacgttacgtgagcaacgcgtcatcagtgaatctgaagctgatgtgacggtatgtacagcacacaggagtaaggggctcgaatgggacagggtgaagttacatgatgactttctcgatattctggatcctgacatgccggaaagtcagcggcaggatgaaattaacctcatgtatgtggcagccacccgggcgcgtaaagtgcttataaccgatccgatattgcacgagcttctgattcagccccgggctgaagatatagccggaacttctgcggataaatcgggtgagtcagaagtgagtacagaaaacgataaaaaagggactgaatatgttccggaaagttaagtcatggatggagaagaaaaacttcagacagatagaagaaaataaatcgggaaatgcgaagaagagacttattccctgtacggatggatattttaaccctgcggccatttcagatttgttacagcatgaacgacggcagcaatggttaaggattttgtgggagaacagcgcgctacctaaagagcgttttgaacgttattttttactccctttacacggcgttgtgggtttatgtcagagactcccggcttcggctcagggaaaatttgcctatacagacggcatggtggattacgtcatacagacgacggtctttgccgtacgtttatcaaaaggatatatgctgccccgaggtgcatctgcagaggaacaatccgcgcagtcagtcagctggagtgctgtcgtttattacgctgcattattccactcgttggggcgcttatggaatattgaaggcgagctccgtagtggtgctgtatggcgcccgggattaagtgttccggaagaaccttatcgttttcgttttaaagcagaacccgatatagcaggtgctcaggtttatggtgaattgatcgctctcagatttttgccagaaccggttcttcagtggctgggtaaaaaccctgatattctgagaacattgctggctttcataagcggacgttacagtgatgcaatggatattacggatatcgttaatgaggccattgtgcatgccggagggatacctcttggttttcccattgcacaggaagagcagacttctgaattagcagagatactaaaccctgccgcgacagtagctcccgtgttgaggaaaggttcttctacaactcctcctgatgtccctgtcatggttgatggagggcaggagactactgtccttttatcttcccttgattctgatgctaagcctgaacgtggggaagggcagcttactgctgaaacagatccagatgttcttcaggtcatgtcgattctgggagggctgacgaacactgacacacagtcgcctgaaaaggaaggcgtgaacacagagaccgatatggtggcaggagaatcgtttccggaagtcgcggttgcacttgagacttcagcagcagaagaggttatcaatgacaccgttaccactgaatgcactggatcatcctcgggtggcatatcatcgctttcctcaacggagctgggagatttgttctggtcctggctaagggatgggcttcgtgagggggatataccagtaaatactgctgatgcctgtgttcatctgacttgtggcttcgtatttatcagcgtcccgggtgttttttttctgtttttgaaatcacattcgcgttcctgttcttctggtctgaaagaaagcgggaggaaggagcaggtgcaggcggcatttgagaagatgcgaaagcatcgggtcagtgattcccggcgattctggcagtgctgtctttatgaagagccagggggcagggggagatacaaaaagttaacagggtatctgataaaaatgtcagagatttatgctaatggtaactttcccgacgacagtttatttctaaaggtcatcaattgaaataaaatgtaacaaaataaatataagaaaagtcttaaaaaaccatcagttcctgtaacaaattgaaatatttttccgttgtcatgtgcatgaaattacgggaatttaaatccacacaagctgtgtgtgtattaataataaaagctcaatagcggtgataaaaatggaaacaaatattacctggcaacaattgatagatgaatatttcttcgcaaaacctctgcgctcagcatctgaatggagttacaccaaagtcttcaaatcatttgtacattatatggggccgttaagctgccctaatgatgtgacatatcacaaagtgcttgcctggcgccgttttcttttaaaagagaaaaagctgtccggacgtacctggaataacaaggtggcgcatatgcgggccatctttaactacggaatacagcgagggttactgcactatgacgaaaatccgtttaacaattcggtagttaaaccggacaagaagagaaagaaaacgctcactcaggcacagattgagtatgcctatcagatcatggagcagtatgaaaatcaggagaatacagggctgggactgaaatattcccgctgcgccttatttcctgcatggttctggctcactgtcctggatacgctctattacacagggatacgtcagaaccagttattacatattcggctgaatgatgttgatttgagagaagggcagattcggctgattacggaggggtgtaaaaatcacaaagaacactatgtgccggtgatcagttttctgcgtccacggctgacctgtttaatggagaaagcgcagagcgaaggattgaaaggtaatgaccgcctgttcaatattgcactttttaccggcaaagatcccgccattggcgatgacatggattctcctcaggtaagagcattcttccgtcgtctgtccaaggagtgtcagtttgcgatcagtcctcatcgtttcagacacacgctggccacggagatgatgaaaatgccggaacagaatctgcatatggcgcaaagtgtgctgggtcattcaaacatgaaatccacgctggagtatgtggagaatgatattgcagtgatggggagggctctggaagcgcagtttatgcagattaaggcagcacatgcccgaagcatttacagtgggttgacaaagaatagataagctgtaacgatatcgggtgatcgagaaaagggaacttgcgccaacaagttcccttacttgagaaacccaaaaatccatctcgatgtgtagactgacctgctacatcgattgtcctttcgggttccacgtaacgtccgttaaggttctcaagccctaaccaacgtactttgataagagtggtgcccggactcgggagcattcagctatctattaaattgaattccgtcataaatccgtttttgacgaattgtcaagaccctgagcgtgacccgtatttttacttgtaaatcaaaatagtggcttttgaggtataaaaacttgttcggttcgatgcactggttcgattccctttaaatctatcgtaatgacatctgcgttacgcgtgttgtatacttaatatccacagaaacacaagaggacaacaccatgccagtcgcaaacagtatggcgatgaaacgcgaaaccctgaacctgcgcatcaagcccgccgagcgcgatcttatcgatcgggctgcaaaagccagagggaaaaactgcacagactttgtgctagaagctgcccgcgccgccgccgaggaagcgctgatcgagcaacgcatcattatggccgatccagaggcttatcaggcatttctgatccgtctggatcaggctcctgcgccaaacgatgcgttgcgtaaaaccatgcagactcctgcaccgtgggagcaggaaaaatgatctccgcccctgaaccgcttcatgccgggcatattcttacccccttctgctgcggtgtggattcaatggataactggctaaaacagcgggcgatgaaaaatcaggtaactggcgcatcccgtacctttgtgtgttgcggcagcgattctgacgtactggcgtattattcgctggcgtccagcgcggtaacgacaaacaccgcccccggtcgctttcgtcgcaatatgcccgatccgatcccggttgtggtgctgggccgtctggcggtggatcggtcgctacatgggcagggcgtaggtcgggcgctggtgagggatgccgggctgcgggtgattcaggtggcggaaactatcggtattcgcgggatgctggtccatgccctgtcggatgaagcgcgggagttttacctgcgggtggggtttgagccgtcgccgatggatccgatgatgttgatggtgacgttgggggatttggttcatgcctgattggtattatttggtgccaataagatggttgttttatgaatcaaattatcaatgatatattgttgctcggcatgtccgctgtctgaagtcatcaggtatcttcagtgtttaatgtgaagtaaaataagatctgcgcacaacctcaaacattattttaatgcttgaggtttgattacaattcaaaagttaaaaattaacttcatccggggaaaaagattagaaaaaaagaccaagaaactaatagaatagaaaatataacacacaataaatattggtgaggtttttaaaactggcttaattgcttttctatatttttcaactaatcccagatcatatagcctggctttcctggagtctcctattaagttactatcaatatcctttgctatgtcttcttctattttatgaaacgctcttttttctgtcatgtcctgtttggaattaaatataaatatgcagaataacaagattgccgcgataacttgaattagtggtatatttacgctccaacatccaagagttgaaataaataaccaaatcccttgtgagtttgcctgagatctaaattcatcaatatgtttactataattcttgatatgttctaatatagcgtcatttttacattgttccatacaattatttccattgtagacatttaaaatcatcagaagaaaagcagctacatgtagctgcctatagatataaagacgctgtcatttccgccctttattggcttgggaaagaactgaagcagcaagcgtctttgtttggtcattatatttagggctatttaaaacttttgaggctgtagtctccatttccccacccgtttggtttgaagtcccagattgggataaagcagatccggctaaacttttctgaatagctgaagcattaggatctttcagcacttgagctgcttgtgatgcaatcgttgaggaggttttcttagtattatttggcatatgtattagcacctatgtagagttacagttttgagcatgtagtatcattttttaataaaacatgccatatgttgtatatactgtattcatatacagttatgagatcaagccaaataatttgatatatatcaaatcatggttatattatgtttaaaacataagagctacaaagcaaacaaaataaaggaatccagttttccagatggccaatggtattcacttggtggcatggtaatacttacggtgttttgttggctctcgctaattaacccgatctctggttaattagcgagagctatattgctaacgttggtggccaccgttccgtgaaacatctaaaacgaaaacatcaattaaatcacggagatcagccggtagtactgcttcaatactaatttttagctcctgagcggttttaattccgtgggttttgcggccagcaacggtttcgctttctccaaaccatatgacaagaaagataccttgctgttcggcatcagggtgaatggaataacggtcatagagttgggctgaagcagcagaatataactctctgtgccactggcctttgacttccgtaaccagcagccgtcttcttcctccaatcaatttagatgctgtgaaatcactcctgttttgccctttcaactgatgctctggagttatagcgataccctgaggctgaagtcttaaactcaggcgctccgcaataatctctgtggactttacctcatcgaggcgttcatttttctcatagaagcgatcagccgagttaaattccccgccatcaatcgctttctgaaaatcatgaagctcctgaagaactaactgacgcaggccttcaacggtaacgactgaatcacaatcaaggcgttgaactatctcatctggcgtcggtggttcaaaatctctgagtgctttttttctgatctgatcagcgtatatgctttgcaactctttatgtagattggtgaaacgtggatcgttaagaagacggtccagcactggtattgcatcatcggaagtgtccgagtttattgaccaaatcaaatcagtcaaaaagcggtaggctttctcttctttagggctatcactaccccagctatcaggtagatcaactcgcggccagtgttcaatgaaagcgtctaaaatggcttcaactttaattgaggcgagttccggccaggcacggtgctcgcttcgattcatacgtccagaacgttcataaaaatgcagtaaattatttttatcagattttaaccatgcccaataagtatccgcaatgttctccataaagtagaattcacgtaccagccagaatattcgtttgcgttcaatatcctcattttctttcggattgggccagcctgacatcatctctgagcaacgctctgcaataatctcttttaaattctcacgatcgccgtattgagcggcaatttcaaaaagtgtatcgactgaattaagggatacatcgggaaaacgacgaagccattcaatggaaagtttagcgcgtgaatgacgaaagacctcttgtctacttaataccccgatttcagggtgagggcatggctgagtgagttggggttcaacgtactgtcggagatatttttcagcactttcactataaggaaaaatgaggcggtcgatttcagtctgtagcgcatcacgttcttctttcgaaactgagtggtatcccctgtgaatgttcgttcttaaggctgtaagcaactcgatattgacgcattcaagattgccttctgcacgtagaatctccagacaggcggcatataaaaccgtctcagaatgcctgtatttagattcgcattgcagtgctgctagttcgggtagagtgggaacctcgggagtaataaaatccagacaatttcgcaacgctgtccgaaccagtttctcgtcaccaaattctaattcaattctttccggatgcatgagcacaagttctgcaaaacgcagcaggcaccgccagtgacgacctcgctctacaatatctctgttctcattaacaaattttatgtttctggcgtggatctctcgttgctttctgtcacggcgtttcatttttcggctatgtctgaatctccggagttggcttttctgcccggataatttcattgcattgttgtatcgggcccattcacgcataaatgcgggcttggagagggcatgccgacgcatttgtgcccgcaaatcatcagggccttgctcttccttgtttctgtaacgttggtggttgacaaggaaactcgcccacaggtcaacgttatctgcttcaaaagccagattgaggataaatttatagtcattcctccataaatgaaggcctgaatgtgagtgcagatgcccgtcgaacttttctactcttgtgttgaatatttcattacgatccgttaaaggcccaaatacataggcaatgatcccctgacgaagtgtgtcattttcccgaagcacttgtaccgatttgctttgatcggcctgacattggtgatgaaaattgagattacctatccattgccagatcctcacaggatcaaatggtgcttgagccagttcaaaatagcgatcgaccattgaaccgacaatcttgcttattccattacgacaatcacattcataggattctttcccacaatggcaataaaggttacaggttaattcgtccagaagaagttcgagagtatgcagtgaaaaacaggaaatgagctttttaataaaataacgaggccgaccactctttcgaattgttcttcgtgaccgggatagagattcgcacagacgcggaagaatccagagagatatcggtggtcgaatttttcgggccctgtgacttcgatgacgttggctgcaatattgagtgaaatattactggcctcaaaaatcaaaacagctaaagcgccaatgcaatcgtattctttgatattgagtaagcatctgcttgctagggttcgaatatgttcagactcattgggatttaacgtaagctggctcaattcaggcaccaactgactgtttactggagagtctgccagaagttctaaaattaaatcacgtaaatgaccatcattgcccatcgttaaaagaggctttatttcctcaacaacgtcttgcgtgaaaaaaccagccgcgctgaaccggcgccagaaatcactccgacgaaagtaaggatctgcggcttcaatctctttgagttgatagagaagctgtcgttttgatgagcgttcaagctgcgatggatcgccgtttgcgagtaccgcataggcgtcaagctcaataatggatccctgtaccgacctgttgcctaatgctgccatccatccgagcagacctctcaactcatctctggcaataccgttcggtgcaataacaggcaagcactttggtaaagtgaggacatccacaggatcggctattcgtttaatgagataatccgctgcgcagtattcagcgacaatcttgtggaccgggcggtgctggtcttccttatcgccgggcttgaaaagctgagttgacaatatgtcgtaacaggccgcactgctgctaaacaacgctggcagcatgggatacatccggtttgccgtcacgtcgatggtgctgactccctctgcgcccgacaacagaagtttggcataaacctcggcagaaaatgaaatcttctgtgcaactgaaagagatacaggggctttcgggatatctggattgacttccttagccagtcgttcgactgctaaagcaaagattgaacgtttgtcagcaaatcgcctgccactttctaaataggcatcggtgaacattttcagaaactgagggtttggtaacaacatgtctaaactaaaccgtgttacttcggtctggaatgcaaagaagtcttcttctggcgcatggtgcttaaagatagcgtgttgctcgtcttgatcgaattctttcagcctcacaaccatcggggagaaaccaagaaatttttcaaaaatgctggtacaagcctgtccccattcgcttgatctacttgacatgattacgcgagtcggctttgatgttctggcgagagcaaggagtttatgaatacctgattgatcaattctggcgacttcatcaacggcatcaattaccagtgcgctattttctttatctgctcctgcgtaagcaaatacgctggcatttaagacagtagtgttcagtttccgagcgaggcttttcatcagttccgttttcccgccgccgggttctgctaacacaacaacgtgcgttgatgccgccagcaactctgtctctgtgtaggttctgtcaccgtgcgtaaaatgacgttcaagatagaagattgaattcatcgttacaaaatttttcgtattgaatagcccaaatattccagcagaaaggaaagctgcgcctgagttttcttgcttatatcagagatagtacggcatttattctttgttggtgggatgttttatcaactgttgtacacattatacaacttattgacattaatcacatttcgccacagcgatgtgcgggctaacagataataaacctttcctgttatggcggtcttgtctgtggaatttttattttctgcgatctgcttccagaacccctcacttgctgctattggctaattgcggtatcttttacacgcacctgcaaattcaggtgccgggattagcctcctgattgacttcatcgacgacacaaaggcgcgtctgcgctttttttgtgtcgtgcgttctgctacatctcaatggtgggccgggcgggggcgctgcaaagcgcgccggtgtcgatgaggccggtaaggctaaccccgtccggttccaccaccatgagattagcctctccggtggtggtgataaacactgctcatcggaggatgccttatggctacgaccctcacccagacacacccgctactctccgttcccttcaatgccgccacggatttcaccgtactggcagaacactgcaaacagttcgccgaaatcctgatcgaacacgacgatcccacgctgaaaatggcactttgcggcaggcttaatgcctgtctgcaacttcttcagccctcactgcttgatccgatcccggagcacatgatggacagcctgatcgttgatacgctccccacccgctcaccgcgtttcgatcccgaatgtactgaactttgtaactactgccttgccctgacgcaggtgctgacgggacaggggctattaccggaaaccagaaattaccttggctgcctgctgtacgacctgatccattatttttctgatgaaatcacggccccgcgctggctgcgtaccgctgacggcgtgaagtttattgacgaggtgacagcatgacgcaacaggactggcatcccgccgacattatcgcggggttgagaaaacggggcacctcgctggcggcgctgtcccgtcagtcggggctggcgtcctcaacgctggcaaatgcgctgataaggcactggcccaaaggcgaaaggctgattgccgaagcgttgggtattgcgccagagcaaatctggccttcccactaccgcaagcctgaaaattactaaatcgtctctcccgatcttctgatggctttgctgtcagaagatcgggagaaggcaagcgaagcgcggcagttcaggctcgcaaataatctttttgacgtacaaacagtttttcctttctgcgccagcggcactggcgtagtctccctcctgctccatgctgtcgtcgacagcgcccaacgcttcacaacctgaaagaagcgcctgttatcaggacggttgatccgtttaccggtgcagacctctgcaaacaccgggtcgcagaacatcgcgacggaggcccgagttttaacactatatgtcctttactgcgccagcctgctggtctgaatctgctccgcgccgaaattttcccggctaacctgtatctgctgacaccctctgcgccttttaccttacggactgcggcctgcaaagacagcaggctttgctgctgcgtggtcgtaaaactgcaccaacgataaattttcagacactgcaccagtccagtgcgtcactttaaccgcgtaaagcgggaaagtgacgcacgcagccttttcgacctgcaccagacaactcaactgcgccagctcatggctggattctgacactgccttttcaggccattttacccataaggagaacatgagccgataccgaggcggatccggacgatccgggggataacccgcacaagcgggcggctgctctgagagcacaaccgaagccccaccacacctcaacggctgccgccccggcgctcaggtatcgttcgcagccccgacaaaaaaacaggggctatcggcctgtgcgccggggaaagcggtatcagtgttggttttttgggatgagtttgcggcaatcatgaaagggggaaaatatggggattctggcgcaggaaatgaagcggcttgcacaacaggcgggcggcagccataagaccgttcacgatcgcattaagctggcgcagggcatcacgaagcgttccctgcaaaacgagatggcggcggtacgttgcattctgaaacaggccgggcgtgacaggctggcgcagagtgagcggctgaacaaccgttctcttggtctgtctggcgcatcccgcaacggtacaaagctggctatcacgccggagcactatcgtgacgtgctggagacagcccgtgtaaaagatccggggatggcggcagcgctggaactctcaaagctgatgggattacgctcgcaggaggcggtgcagagcgtacagtcgctgaaaacgtggcggcaggcgctggatcgtggtgacacccgcttaaccgtagtgtttggcaccaaaggcgggcgaccccgcgagacgattattcttgatgcggtagcagtcagaaaagcgctggataatgcgctggctgtggcagaagatcgtcacgacaggctgatagataagccggatctgaaaaccgcgatgaaatactggcacagtcaggcgtcacgtctcggcttaacgggcgcatattccccgcactcgttgcgctatgcgtgggcgcaggatgcgatccgtcattatctggcgcagggatttagtgagaaggaagcgctggcaatgacggcgatggatttggggcacggcgacggacgcggacggtatgtggcgcaggtttacgggagaaaggatggtggtgattgatagcttcagacttgcaatatgaggttatccatcggttttcgtacaaaaaattttgggggcaaaattttttgtacggtttccttttaataacgatgtttctaaatggtctagcctattaacaggcttctggtgcagcattccgttatttttttctggtgattgtgccagcaaaagggaaaaggccagataaaggtaaagggcggctaagggtaacagcgccagaccggaaaaggccaaagggcttaaaaggataaagctggcgcagatcggtatttatccggtggtatctggcgcaatcctgacatagacaggcgacggcagactggtgcagataaacgatgacactgaactggtgcagttatggcgtatcggcaaatcagtttctggtgcagattgtctggctgctatcgcctgaaattattctcctcaaataattttctatatttacctattgattcgcgaaatattgatagattttcgtacaaaattattctacgtagaataattttgtacgctttcctattaacaaccaaaaaatgcaaggtaattcctttcaatacaaaaagcagattcggattcaatcaggatctgctttttcattatcaacaaattatattgccgctggctcaggccgccttatgccgctgcgcataaatatagggcgcaacgtacccctcgcggctcatgtcgagataattcgaccaccactgcatcatctccatacgcgcttccagatgctccgctttatgtacatatgccgcacgcacgccgttgcgctccttgtggctcatctggcgctcgatggcgtccttagaccacagcgcagactcgttcagggcgctacaggccattgtgcggaagccatgaccacagacttcggttttggtgtcgtaaccacccgatctgcacttagaagtcgggtggctaaaagtattttatacttattcattaggaatgagaattcattcaaattttatgacttaatgatttattgcttttgtataggaacgattgacccaaccatagatcttttgttctccgaatgacagttgtacatataaccatttcctgtcacttttatcgataacgatcacgggagtatatttttccaacttaaccaatacatcgccttgcattgatggtgtgttccgtaatcggacattttctccagtaattattcttatgtgttttaatgtgctaatgtcaacttcgcggggtaactgttttgttaattctttaaaatgagttcttggtgatatagatttactaacatattgttgcgcttgttccattaaattcattgctaattctttgtttttatccacaacgactgaatacatggtggttacaagataaatgatgatgagttgtactaataatggtaattttctaaagtttgaagttatagggcttttttcgatataattttttaattttgttaatgcgtcaggctcttttacttctactgcatggatatttgttgcaataattgctgcaccttgaggtgagcgtgaaaatagaatggccgcttcctgtaatgtttgaatttcggttgcatctaatttttctaattgtttagcaatgcttgtagcgaaataattttcgttgaatatccccccctgctttttgaaaagagcggtaatgcccgagtcctgcaccagcttctgagctgcgaatgcgctgctgacagcggtactggcaaaaagtgattcatggcttttcaggaaagcggcaacgctggagccctgtgccagcttctgagttgcgaatgcgctgctgacagcggtaccggcaagaagtgattcatggtttttcaggaaagcggcagcgctggagccctgtgccagcttctgagttgcgaatgcgctgctgacagcggtaccggcaagaagtgattcatggtttttcaggaaagcggcagcgctggagccctgtgccagcttctgagttgcgaatgcgctgctgacagcggtaccggcaagaagtgattcatggtttttcaggaaagcagcagcgctggagccctgtgccggcttctgagttgcgaatgcgctgctgacagcggtaccggcaagaagtgattcatggtttttcaggaaagcggcagcgctggagccctgtaccagcttgtgagctggggatgcactgccaatagcggaaaacactgtgttctggagtttattttcactcataattgagggcttggatggtaagccagttccattctcattattgttgagcagtgtttttttctctttcatcatttcacatcctgaatgacggatttttattgataatataaggttttttcaatttatcgtataggacataacactgtgtgggcaatcattcgtttggagatacattagtactaagcactgcaaaagatgttcatctgaatgagccattttgtattaataggttttcgtacaaaaatattctacgtagaatatttttgtaggctttcctattaacaatcaaaaaattgaagttaaatcctttcaatacaaaaagcagatccggattcaatcaggatctgctttttcattatcaacaaattatattgccgctgggtcaggcagccttatgccgccgcgcataaatatacggcgcgacgtacccctcgcggctcatgtcgagataatccgaccaccactgcatcatctccatacgcgcttccagatgctccgccttatgcacatacgccgcccgcatgccgttgcgctccttgtggctcatctggcgctcgatggcgtccttagaccacagtgcggattcgttcagggcgctacaggccatcgttctgaatccgtgaccgcagacttcggttttggtgtcgtaaccaatcacgcgcagcgccttgttgatggtgttttcactcatcggcttgttcattgagtgagcacccgcaaaaacaaataccgactctccggtaatttcctttatctgctccagcagggcgacagcctgcgcagatagcggcaccagatgctcatccttcatctttgcgccacgctctgagaaacgcacgttcttcaccgcttcccgctttgctggcaccgtccagatacgagctttcaggttgaactcatcccagcgggcgaggcgtaactcactggagcgcaggaaaacgtgcagattcaactccagcgccagacgggtcagttcccgccctttgtagccattaatcttgtccagcagctccggcaggcgtttcaggggcagggcggggtgatgttgggtcacaacaggggtcacgacgccatccagatcgtaagccggattatatttaatcgttccctgctgtacggcatgacgcatgattttggtcagatgctggcgcacccgcccggcaacgtcatgcacgcccttatcgtcgatggatttaacaagctgcgccagatggcgggtttcaacctctgcaatgtccattgcgccaatatcggggaagacgtagcgcttcaggcaggtcaggatcttgtccgcgtggtcttctgaccacagcttaagacaactggagtgccacgccgtggcgatgtactgaaaggtgcgcgtaccgtcaacggcggctttttccgccttgcggggcagagaagggcaaacgccggataccagcagcttacgcgccgcatcgcgtttttcgcgggcttccgccagcgtaacctgcggataggggccgaaggccagacgattttccttaccttcaaaacggtagcggaaataccatagctttgaaccactggtggataccgtcaggtacagaccttgtgcatcagtgagtttataggattttgcgaggggtttcgcggcgcggatcttgctgtcagtcaacatgagggcctctccgttcatcgaactgaatgaaccttcaacctgacccctaattttccggatacgtagggataaatcaaaacgcatctggaaagatttttacgctaacttattgaattacatacatattggaattcatagggaagcataaaaaaggaaaggtggtgcccggactcggaatcgaaccaaggacacggggattttcaatcccctgctctaccgactgagctatccgggcaacggggcgcattaaaccgtaaaggggcgcggtcgtcaacggctttacacgaaaaaagtgataaaagcgcgctgactgcctgcttttcaggcaaaatgcataaaatcagtacccgtcaggtgagcgctccaccctgacggcactgtgcaaaacgcagaatatcttccgccaaccgctgagcggtatctacatcagcctgactgcggttgaccagcattcggctgagacaaccttccagcaccagttccatctgccttgcaaccatcgccggatcgtcaatttccagcgtggtcagtagcccatgggtaaaatcatgtgccgcgcgtttttgttgattagccagttggtgaataggatgggttgggtcgggataaaacgtacaggcggcaatgaacaagcaaccaggataacggttattactgacacattccgaaagcgcgctgtagcgtgccagtagcttttgttcagcagaaaacgtctcatcaagaagaagctggcgtcgccagatatctacctgctgactcagataacgtagcgcgtcatataaaatggcttctttatctggccagaaacgctgtaatgtgtcgagtgggcgatttacgcgctccgccaccatttccagcgtagtatcggctatcccttgcgtctccagtaatttcagggcttctcccagaatatcttcacgttgcacggtattctcctccgtctttgcttttgcaagtgtcgctcatggttggcgatcgtgcaaatgcgcgctaaaggtggcggcgtccataaagccggtgactcgcgcttgcggctgttcctggccttgggcatcaaagaacagaatggtgggcagcccgagaacttgcagatgctttaacagcgcgacgtcctgcgcattgttagcggtgacgttagcctgcaagagcaccgtgtcgccgagcacctgctggaccctcggatcgctgaaggtatacttttcaaactctttacaggccacgcaccagtcggcgtagaaatccagcataacgggtttgcctttggcctgcgccagcgcctgattgagttcatccacggtagaaatagccgtgaaattgaggtgcgctggagcttgcgcggatggcgatccgaatgcccaatcttgtagaggccgcacgctaatgagcgctgccgccagcaggataatctgtacgatacgcatccacgctcgtctggcctgaaggctggtgataaaggcccaaccaaagaaagcgacgcccagcagcgaccacagacgtaaaccccaagcctcgccaataatccgctccagtaaaaagaccggtaacgcgaggatcacgaaaccaaaagcggttttaacatgcgccatccacgggccgcttttcggtagcagacggttgccaaacacggtgaccagcattagcggcagacccatacctaatgcatacaaatacagcgtaccgccgcccagccacatgttgccgctctgagcgatataaagcaggatcgcgcttaatggcgctgtggtacagggcgagcaaattaatcctgcaatcgcccccataacaaaaacaccgccgggcgagccgccttgctgacgattactcattaatgtcagccgggtttgcagtgaggaggggagctgtagtgtgaacaggccaaacatcgacaacgcaagcagggtgaacacgatggcaaggccgattaacacataagggtgctgcagcgccgcctgaaactgtaatcccgccgcggcgacgaccagacccagtgcggtataggtcagcgccatcccttgtacatagataaaggccagcagcagtgcgcgccccgtcgacaaacgttgccttccccccaggacaataccggaaatcagcggatacataggtaaaacgcagggcgtaaaggcgatgcctatgccgatcagtagcgcccagagcgcagaaaaaggtagctgggcggcgggttttgacgtctcacccgtctgggtgacagcaggcgtcggcgtggcgtctattgccgcggcgacttcacttagcggcaccgttttcgtttccggcggataacagaatcccgcatcggcgcacccctggtacgttatcgttaatgtcgcgccagccgccgcctggttaaccgttaccggaacgtttagccgcttacggtagatttcgctttttccgtagaattcatcttcatgccagacgcctgccgggagttggactgcggcgatatccgctttcgtcggcgtgatactgatttgtttacggtaaaggtagtaaccctcttttacctgccaggagagggtaagatcgtgttgattttgctgaaaatcaaaaacaaacgcccggtcggcagggacgaactgcgagcgacccggcgcgtcgaataatccggcgaaggcggatgtgctgcacagcagcaggatcagcgtaaagatgcgttgagccatgagaggtaatcagtatctccgtgagtaacaggtaaaaccagaagttcaggcgtttgatacgggtgatgagacttcaggcagtcgataagcgcttgctgatgtgaaacggtggtttttaagatcatttgaacttcatactcctgctccagtttgccttcccagtagtacagcgatgtcgcgccggggaggagggtggcgcaggcggccagtttttccgccagcactttggcggccagatcctgggcggtagcttcatccggggcggtacaaagcaccacaacagcctcggggatggaaatatcctgactcttaacatcaagcataaacacctcgaaagaacaaaaagacccgcaagtgaacggtcactatacaacggacgagggcaggatgttagtcaaagggcgggagaatgcggggcgtgatacgccccgcgggtgaaacacttacagcataaagctgcccagcaggaagccggagcagatagccagaacgacgcccagggtgcctgggatgaagaacgggtggttaaagacgaatttaccgatacgggttgtaccggtgtcatccatctgtaccgccgcaaccagagtcgggtaggtcggcaaaatgaacaggccggaaacggcggcgaaggaagcgactgccgtcagcggagagacgttcagcgccagcgccatcggcatcagcgctttcgccgttgccgcctgagagtagagcagcgcggaagcaaagaagaagatgacggccagcagccacggatgcccctggatgacgctacccgcagtgtctttgatccagtcgatgttagcggatacgaaggtatcgcccagccacgccacgcccagaatacaaatacaggcgctcatccctgctttaaaggtactggagttgaggatggcgtcagtttccactttacacaggatggtggtcagcgttgcgacgctcaacatgatgatcaaaatagcgttggtggtgttcatcagcggtttctcaaccaggccgaggctcggactgttgacaatcgcataaacaaccacgcagataacgcccagcaggaacagccagacggaattttttgccatcggtttgatttcaatctgcttttcaccacgcagttcaatcagcccttcttccagacgcttgcggtaaatcgggtcgtccgacagtttggagttgaacagcatcgtgaccaggaaggacatcaccagcaccgccagcagcgtagaggggataaccacggacagcaggtgaatgtagctaatgccatgaccttccataacagaagacatatacaccacagccgcagaaatcggcgaggcggtaatcgcaatctgcgcggataccacggcggttgagagcggacggcaaggtttgattccctgctccttcgcgacttcagcaataaccggcagcgttgccagggaaatgttcccggtaccagcaaaaatagtcaggaaataggtcacaatcggtgcgaggatagtgatgtatttcgggttcttacgcagcagtttttctgtctggtttaccaaataatccagaccgcccgcgacctgcatagcagagatcgcggcgataaccgccatgatgatggaaatgacatcgaatggaattgtccctggcttcacgccgatggcggcaagtaccagaacacccagcccacctgcgaatccaataccgatgcccccaagtctggcgcccaaaaagattgccagcaaaacaatgataagttcgacaactatcatattagccttccttgttgtttaacaagttgatattaaattgttgttatttggtaacttcttgtaagaaaaaaggcacgtcatcgtgacgtgcctctttggtactaccctgtacgattactgttcgctttcatcagtataacgtttagctttataagccgggtgcatcaagttctgtacggagaaaatatcgtccagctcggcttccgttaacaggccgcgctctagcacaacttcacgtacgctcttaccggtttcagcacagattttaccgacgatgtcgccgttgtggtggccgatgaacgggttgaggtaagtgacgataccgatggagttataaacgtacccttcgcacacttctttattcgcggtaatgccgttaacgcatttttccagcaggttgtagcacgcgttgctcagaatgtggatggattcgaacatcgcctgaccgataaccggctccataacgttcaactgcaactgaccggcttccgccgccatcgtaacggtggtgtcgttaccgatgactttaaagcatacctggtttacgacttccggtactaccgggttcactttggctggcatgatggaagagcccgcctgcagttccggcaggttgatctcgttcaggccggcacgaggaccagaagagagcaagcgcaggtcgttacagattttggacatcttcactgccagacgtttcagcgcgctgtgaaccataacatacgcgccacagtcagatgtcgcctcaatcagatcttcagccggaacacaggcgaaaccagtgacttcagccagttttttcaccgccagcggagagtattctttcggcgtgttcagaccagtaccgattgccgttgcgccaaggttgacttccagcagcagctcagcagtacgctcgatgcttttcacttcttctttcagcagaatgctgaacgcacggaattcttgaccaagcgtcatcggtacggcgtcctgcaactgggtacgacccattttcaggatgtcctggaattcaaccgctttacgttcgaaaccttcacgcaactggttgatggcatcgatcagtttgacgatagaggcgtaaaccgctacacggaagcctgtcggataggcgtcgttagtggattgacatttattcacgtggtcgttcgggttcaggtactgatattcacctttctgatgacccatcagttccagcccgatgttggccagcacttcgttggtattcatgttgacggaagtgcccgcgccgccctggtagacatctaccgggaactggtccatgcacttaccgttgttaaggacttcatcacatgcggcaatgatggcattcgccacactcttaggaatggtttgcagctctttgttggccagcgccgccgctttttttaccataaccatgccacgcacaaattcagggatgtcgctgattttgttattgctaatgtagaagttttcaatcgctctcagagtgtgaacaccatagtaggcttcagctggaacttccctggtacccaacagatcttcttcgatacgaatgttgtttgacatgtgaaccttctttttcaagctgccaatgatttttactttaaaacacacaggatatatgtgatttcgaatgttttctgaccgacgattatcccctccatcggcctgataaacgagatcatatgctggttcagaattcctaccgtaatctggatcacttaaagtgtgggaatttaccccttatttattattttgtgaaataggtcaccgctttagtattactacctaaaataggtgtacaaaccacttgaaattttgctacgcaccaccatatcgaatcgatgcgaatcgcaaccccatttaaatggtcgtcgcagacggccatgacttacaggagagtcctttgcgctggataccctttttagctgtctttctctatgtttacattgagatttctatctttatccaggtcgcccatgtgcttggcgtcctgatgacgctaatcctggtgatttttacgtctgttatcggtatgtcgctggtacgtaaccagggttttaaaaactttttgctgatgcaacaaaaaatggcggccggtgagagcccggcggcagaaatgattaagagtgtatcgctgatcatcgctggcttactgctcctgttgccgggatttttcaccgattttctcggccttctccttttgttaccgccagtgcaaaaacatttgacgctgaagttgctgccgcatttacgtttttcccggatgccgggcggcgggtttagcgcgggtactggcggtggcgaaacatttgacggcgagtatcagcgtaaagatgacgatcgcgatcgtattgaacataaagacgatcgtcgggattaaaggtagagatgctggtcggataagtcgcgtgaggcgttatccggccaacagatacgtcttacgccatgcgttttcgcttcggtaaaaacagccataatgctgccagcataataatggcatataagcttttccaccccagcattactagcaataacaggcacagtagacaacccgtcaccgccagtgcatagcagcgccctttcaacagtcgacagcccgccagcatacaaagtagatagagcataataaaaataccgttagcatagacgatcagcgcattgaggttaatcttcagggcgtagacgaccagggaactcacgcaacaacaggccagaataacgtttaacgcgtgcaagggaaggcgcccgggagagagttgagccagatagtgatcgggctgatattgcatttgcgtccatatcagacgcgcaaaactctgagcatacatattcaggctggcaaagcaggtgagataaccaataatgcaggctatccacaacgcctggataccgaagagatgaacaataataagcggtagcgatgctgttgccgctatcttgtcgctatagacgccaaaatgcagcaccacggcggtacaggtccaataaatggcgccggccagcatcaggccaatgatcaatgcgcgcggaaaatcacgttcaggatttttaaattcagacgacaaatgcgtaaaagcctcaattcccacaaatccccagaacatgatcgccagggcggtacacagccgggaaaagatgatttcgtttgcggctgggaaggtgatatctgcaggtttaatcgcgcctttccacagaatggcggcaataagcgcgataattaatccagcgataatggcttgcaggttggcgctggagctggcgccgcgcgatcccataaaccatagcaaacctagagtacccagctccccaaataagagctgttcgctttgccagccaaacagcgcctggccgaaacccaccgcaatatgcaaggctgcgggaaaactaacaggaatgactgataaaaacagccaactgatcacccgttgcagacgcgggccaaatgccatcccgacaaaatgcgctacgccgccagcgtgtggaaaatgacgccccagcacagcaaagacaatcgcaatagggaaaatcaaaataatgagcagcggccatgcccaaaggctgatgtcgcctgccgccagcgcagccagctccggaagcgcaaaaacgccagtccctaataatgatgtggttaacaagataacgccctgaaccaacccaagctctttttttagttcattcatcagctcattatccggcggcattgtaacgtcaggtgacgacagacatttttaagcgtatcacacacgccttttcttatagcaggatgttctaaaccttgggtaaacgtgagataagtagcgtttttaccgcttttttcgctcagaagaattttttttcatctccccccttgaaggggcaaaaccccatccccatctctctggtcaccagccgggaaaccgtttacgggccggcgtcacccataactgataatgactttctcaaaggagagctatcaatgagtattcgtccgttacatgatcgtgtgatcgtcaaacgtaaagaagttgagtccaaatctgctggcggcatcgtactgaccggttccgcagcgggtaaatcaactcgtggcgaaatcatcgctgtcggtaagggtcgcatcctggacaacggtactgtacagccgctggacgtgaaagttggcgacatcgttatttttaacgatggctacggtgtgaaatctgaaaagatcgacaatgaagaagtgttgatcatgtctgaaagcgacattctggcaattgttgaagcgtaatccgcgaacgacactgaacatacgaatttaagggaaagagaaaatggcagctaaagacgtaaaattcggtaacgacgctcgtgtgaaaatgctgcgcggcgtaaacgtactggcagatgcagtgaaagtaaccctcggtccgaaaggccgtaacgtggttctggataaatctttcggtgcgccgactatcactaaagatggtgtttccgtagcgcgtgaaatcgagctggaagacaagtttgaaaacatgggcgcgcagatggtgaaagaagttgcctctaaagcgaacgacgctgcaggcgacggcaccaccaccgcgaccgtactggcgcagtccatcattaccgaaggcctgaaagccgttgctgcgggcatgaacccgatggacctgaaacgtggtatcgacaaagcggttgctgctgcggttgaagagctgaaggcgctgtccgtaccgtgctccgactctaaagcgattgctcaggtaggtactatttccgctaactccgacgaaaccgtaggtaaactgatcgcggaagcgatggataaagtcggtaaagaaggcgtcatcactgttgaagacggtaccggtctgcaggacgaactggacgtggttgaaggtatgcagtttgaccgcggctacctgtctccttacttcatcaacaagccggaaactggcgcagtagaactggaaagcccgttcatcctgctggctgataagaaaatctccaacatccgcgaaatgctgccggttctggaagccgttgcaaaagcaggcaaaccgctgctgatcatcgctgaagatgttgaaggcgaagcgctggctaccctggtagtgaacaccatgcgtggcatcgtgaaagtggctgcggttaaagcaccgggcttcggcgatcgtcgtaaggcgatgctgcaggatatcgctaccctgaccggcggtaccgtaatctctgaagagatcggtatggagctggaaaaagcaaccctggaagacctgggtcaggcgaaacgtgttgtgatcaacaaagacaccaccaccatcattgatggcgtgggtgaagaagctgccatccagggccgtgttgctcagatccgtcagcagattgaagaagcgacctccgactacgatcgtgaaaaactgcaggagcgcgtagcgaaactggcaggcggcgttgcggtaatcaaagttggcgctgcgaccgaagttgaaatgaaagagaagaaagcccgcgttgaagatgccctgcacgcgacccgtgctgcggtagaagaaggcgtggttgctggtggtggcgttgcgctgatccgcgttgcttctaaaattgctgacctgaaaggccagaacgaagaccagaacgtgggtatcaaagttgcgctgcgcgcaatggaagctccgctgcgtcagatcgtgctgaactgcggcgaagagccgtctgttgtcgctaacaccgttaaaggcggcgacggtaactacggttacaacgcagcaactgaagaatacggcaacatgatcgatatgggtatcttggacccaaccaaagttacccgttctgcgctgcaatacgcggcttctgtggctggtctgatgatcactaccgagtgcatggtgaccgacctgccgaaaagcgatgctcctgatttaggcgctgctggcggcatgggtggtatgggtggtatgggcggcatgatgtaattgcccaccccctgcatccttcaggctgcagatgcgttggctaaccccagtcacttacttgagtaagtgactggggattaacaaactggccgccttcctgcaaccagaatgatttgggtgcttatctcccagaattgagaaacccccgggcagaaatgaccgggggtttttcttttagtcatctttttagtataagattcagatacggacaaaacgtccagctcattgattatggggaataacatgcacgtgaaatatttagcagggatcgttggcgccgcgctgctgatggcgggttgtagctccagcaacgaactcaccgctgccggccaaaatgtacgctttgtcgaagataagccgggcgcggaatgccagcttattggtacggcaactggtaaacagagtaactggttttcaggccagcacggcgaagagggtggctcaatgcgtggcgcagcgaacgatctgcgtaatcaggcggccgcgatgggtggaaacgtgctgtatggcgtaagtagtccgtcgcagggcatgttgtccagttttgtcccgacggccagcgagatgaacggccaggtttataaatgtccgaattgacatgtctgaatcgtaacgccctctgaaagattcagagggcgatatggttagcgtttttcctgcgatgacgccatgcgtagattatgcaacgcgcgcatacattgatcttgcgtcagacgcgctgctttaccggttccaagcgttctgacaaaaaccttacacggttttccttccagctttttaagacgcgggctgaaattcagcaagcggcgtgatatcgcttcagcttctttagagcctgactgactgcgggtcttaatgatggtgccgcaatcatgcgattgtcctgcctcatccgtataacgataaacgagcgctaaataatggttatacagattatgtttccagtcaggctggttataggtatcgaattcgatattaccgttatccaggcagtcagcatcgtataatggtaaaaagtccagcattgaagaaatacgcaatgcgagctcacgcatttcggcattattaatggcgtgaataatagccatcaccagaacttcaacctgccactcaccgacctgtaaatcaagatggctaccattgtgcagctttaacgtaaaggttaatactttttctgtattatcgctcaacgctaaagattcaacacgctgattaacatcggcgttttccagctcttcacggagtattgccggaatattctcatgcattttaagcacatgactgcttttggctttctggcgtttttcctgctcttgttccggaagcgagtattgtaaataaagccggtgttcaaggccgatcaacaagtctcgcagcgcgagcacaggaaagaaaagcagtgtttctttatttctcagtgacttcaccttaagcgccagcgcgataaacttatcattgtgacgaataacgccggtatttagtcccttaatcgttaaggccatgtcaattctccacaaatataaaataattaaatgttttactgcaatgtatttgatatataaattgtttatgccgtcctataaaaaggagaaccagtataattcgaaaatgcagtacacgctaagcgagtcctaaaacggactttattgaaaagagagtatcggaaaggtgtatttaacgaaggttagtttatcctcgccagagggtgaggagaatcgcgggggaatctcctcgtgatattgcgcggtaatatttttcgtcgtccctgacgcgcccgcgaggattagcactgccgaagctgtaaatccagcggtgttttgctcggttcgccgccgatttcacgcgccagtcttggcaccatatagccggataccagcgtgagcagttcgcgcatgatttgccgggcttcgtcatcggtgaccataaaatgcgcggcgccctgcactttatccagcacatgcaggtaatagggcatcacgccggcgtcaaatagcgcgttgctcagattcgccagcgtttgcgcgttatcattcacgccacgcagcaggacgctctggttgagaagcgtgacgcccacgtggcgcagtttcttcatcgccaggcagaacgcctcgtccacttcattggcgtggttgatatggttcaccaacaaaatttgcagacatgactggtcaaagcgggcgaccagttcgtcagtaatgcgtgccgggataacgataggcaaccgactgtggatgcgtagccgcttgacgtgcttaatggcttccagttgcgtgagcagccagtccagctcatgatctttcgccatcagcggatcgccgccggaaaagatgatctcatccagttccgggtgtgcggcgatatactccagcgcgactgtccagttgcgcttattgccttgattctccgcatacgggaagtgacgacggaaacagtagcggcaatttaccgcacatccgccttttaccagcaatagcgcccggttttggtatttatgcaataatcctggcaccacgctgtgttgctcttccagcgggtcggtggagaaaccgggggcgacaataaattcatcccgggacgtcagcacttgacgtaaaagaggatcgtcagggttgcccttctccatgcgcgcaataaaagcgcgcggcacgcggagggcaaacaagcgcctggcgtcctgtcttgcccggaggttttcatcagcttcaatctgtaaaagatgcagcagttcgtcgggattggtcacaacatcggcaagttgcgctaaccaatcttctcgcaatggggtatttagggttacaatatgcgccattttgtggcttagctaccagttaacaatttcagagggccttatggcgacttactatagcaacgattttcgttccggtcttaaaatcatgttggatggcgaaccttatgcggttgaatccagtgaattcgtgaaaccgggtaaaggccaggcgtttgcccgcgttaagctgcgccgtctgctgaccggcacgcgcgttgagaaaaccttcaaatcgaccgattccgctgaaggcgcggatgtagtcgatatgaacctgacttacctgtacaacgatggtgagttctggcatttcatgaacaacgaaaccttcgaacagctgtctgcagatgccaaggctattggcgacaacgcaaaatggctgttggatcaggcggaatgcatcgtaaccctgtggaacggtcagcctatctctgtcactccgccgaactttgttgaactggaaattgttgataccgacccaggtctgaagggcgataccgcaggtactggcggcaaaccagccacgctgtctactggcgcagtggttaaagttccgctgttcgtgcagattggcgaagtgatcaaagtcgatacccgttccggcgaatacgtatcccgcgtaaaataatttacgttatcgggaaaaatggtgcagcgtatgctgcgccatcctatttttcgcgcctcaatgatgaaacgctttatcggccttgtcgcgctggttcttcttaccggcacattattaacggcatgtaataccgcccgcggcttcggcgaagatattcagcatcttggccacgccatctcccgcgcagccagctaatcgcttctcgtcttcctaaaattagtcgatcgcccgtcattttctgggatgttgtctattattaagttgctatacacaaacaacattggctagaaaaggaagacattatggttaaaaagacaattgcagcgatcttttctgttttggtactttccactgtattaactgcttgtaataccacgcgcggcgtgggcgaggacatctcggacggtggtagtgcgatctctggcgctgcaaccagagctcagcagtaatcatcaacggtacggcatggcgtcgtaccgttaatcgattttctccggaagcataagaaagggagaataccggttatccatatgaagtttcatacggatattacgcttataggtgtaaaccgtttttccgtgaatgccaagcgcatacgcaatctctttattgctggtgccttccgtccacatcgcgagcactttttcctcctgcggagagagcaatggcgtggcgctttccggcgcttcctgcagtggatgagtatatagcgctcctttaattcgttgtgcaagctcatgtaaaggcgtgtgtttagataacaccgcatggctggcatattgcgatctgtacggcatattccctgactgtaataatactaacggcgtcatcctgcaggcggcaaaaaatgcattgataggctgctcgggtaaggcatcgttgagaaaaccatataaatcagcgataaccagatggggcttccattgcagaatatgttctttcgccagtataaggttattcatcccggataccagcagtgaagaactgagcacatcagtgtgattaagccaggcctccatgcccgtacgggtaaagtggcatcggtctatcactaaaattttcaacatagttttttgtacccggaagtagtaaagcactttctttcccagaaggcgttccatcatagagaactcctgtgggcgctaaatgcgaaaactacgcggcttaaaagggccaattcccgcctttagacggaaaaaaataaaaaggttgaaattcattttctctcaggcaagaatggcttttcatccgtatacgttacaggacgacctgtaaacgctattctcaccggggacggccccattaattatctggagcctgctatgtcctggatcattttattaatcgctggtttacttgaagtggtatgggctgtcggcctgaagtatacccacggtttttctcgtctgacccccagtattatcaccattacggccatggttatcagtatggcgttactttcctgggcaatgaaaacgctgcctgttggaacggcgtacgccatctggaccggcatcggcgccgttggggcggcaatcaccggtatccttctgctgggcgagtctgcctcaccggcgcgtttgctcagtcttggcttgatcgtcgcgggtatcattgggctaaaactcagtgcgcattaattcgtcgctgacattgctacgaacctgattgttttacccaaattaatttattgacgtcaaacccctcccgggtcgcgacggccagcatttgctgttttatttcctcagaaagcgttggcgtgcgagagagtatccacagatagtcgcgattcgggccgcacaccagcgcatgacggtattcccggtcaagcgcaatcacgttatagccgccgtagaacgggccgaaaaaagagaccttgagcgcggcgcggtttggactaccggtaaaatacgctttgccttctgttttttgccacatttcccgagccgggttatagcctttattgatgacattaatcccgccatcgtcacgcagactataggtggtcgtgacttgttccagtccacgttcaaatcgatgatcgaggcgtgcgatctcataccaggtgtcgaggtaacgtttggcatcaaagttatttaccacggtaacgcctttaggcggggtaggcgaactacaggcgacaaccaaaaatgccgcagtaaccgcagcaacgacgggcagcaagcgcatagcgtttttccttccagtgttttttctaagtgtagaacctggcgggaaaatgagaggcaggaaaagaaaaaatgccctcttatcgggtagataagagggcgtcgtggcaacttagagagtgataacgccaatcgccgtcacaacggtcaggattgccgccagaccgtagaagacccatttgcccgcaggcacgtggattttcaggtcatgcatcgcgtggtgcatacggtgtaggccacaccatagcggtagcacgatcatcaggaacagaaaaacgcgaccaataaagctttgggcgaacgtcagtacgcgctcaaaactcagggcatcgcccggaaatagccccagcggcagcatgatgccaaccagtagcacgatcaccggcgcgatgatcgcgccccacataccgcctgcgccaaacagtccccagaatacgggttcatcagaacgttttgggtttggattaatcatccgggactccttaccagaacagggcaacatacagaatgactacggtgactaccgcagtgaccacccaaagccctttgatgattggctctggccccattttttcgtcttttacaatgatattggccgtcttcggcgccagttcaaaccaggttttggtgtgcagcagcgcggccgccagggtgatcaggtttaagatcactaccaccgggttttgtaaaaagccgacgaatcccatccaggattccgcgccgtgtttgagcgcaaacagaccgaaaatcagttcaatactgaaccagactgccggcaccgctgtgccttcgcgcagcatataaaagcgataaaacggcagttttttccaccaggtggacgtcatcggccgcacatagggtttgcgtttagtcgtcatgttgcactccttagcgtggtttcagggtggcgataagaaagtctttcgagctttccactttaccctgctgaatggccgcagccggatcgacatgttttggacagacttcggagcagtagcccacgaaagtacaggtccatacgccgttcggactgttcaactgcgccatacgctccttcttaccgtgatcgcggctatcttcgttatagcgatgcgccagcgtaatcgcagccggtccgataaactcaggattcagaccgaactgcgggcacgcggcatagcacagaccacagttgatgcaaccggagaactggtgatacttcgccatttgcgccggggtctggacattcggcccctgatctggcgtgcgagagttgccaataatgtacggtttgatcgcttccaggctttcgataaagtgcgtcatatcgataaccagatcgcgctcaatcgggaagttcgccagcgcttccaccttcataccgttggtgtaatcgcgcaggaaggttttacacgccagtttaggaacgttgttgaccatcatgccgcaggagccgcagatcgccatacggcaggaccagcggtagctcaggtctggcgacaggttatctttgatgtagcccaacgcgtccagtagcgatgttgtttcatcataaggaacttcatagaaagcactgtgcggcgcggtatcggtttccgggttatagcgcaccacctcaactttcaggtttttcatctcagccattcgccttctccttcttatcggctgcttccgcttcaccgccgtaaacacgtttggctggcggcagggtggtgattttcacgtcgctgtattccaggcgggtcgtgccatcagcatcgcggaaggcgagggtgtgcttgaggaagttcacatcgtcgcgctcggtacagccttcatccagacgctgatgcgcgccgcgggactctttacgcgccagcgcagagtgcgccatacattccgccacgttcagaccatgacccagttcgatggtatacagcaggtcagtgttgaacacgctggaagtatcggagatacgtacgcgcttgaaacgttcctgaagctcggccagtttatcaacggttttctgcatcagttccggggtacggtaaataccgcaaccttcttccatagacagacccatctcatcgcggatcttcgaccagttttcgttgccttcctggttcaccagatttttcagacgctgttcaatatcggcaacctgggcgtcgagcgcggcgctatttgcggcgcctgccgtagcagcgcgttccattgcttgttcgccagccagacgaccaaacaccaccagttccgccagtgagttggaaccgaggcggttcgcgccatgcaggccaacagaggagcattcgccaacggcaaacagccctttgacacggctttcacagttctggtcggtttcaatgccgcccatggtgtagtgcgcggtcggacgtactggaatcggttctttaaccggatcgacgccgacataggctttcgccagttcgcaaatgaacggcagacgttcatgcagtttcttctcgccgagatgacgcaggtcgaggtgaaccacatcgccgcgcggcgtggagatggtgttgcctttacgccattcgtgccagaaagcctgggatactttgtcgcgcggccccagttccatatatttgtttttcggctcgcccagcggcgtttcggggcccatgccgtagtcttgcaggtaacggtagccatttttattgaccagaataccgccttcgccgcggcaaccttcagtcatcaggataccggaacctggcaggccggtcgggtgatactgaacgaattccatatcacgcagcggaacgccgtggctcagcgccatgcccatcccgtcgccggtgacgatgccgccgttggtgttatagcggtatacgcggcctgcgccgcctgtcgccatgaccacggcgttggcgcggatttgtaccagcgtgccttccatcatgttcattgccaccaggccgcgcgcatggttgtcatcaaccagaatatccagcacaaaatgttcgtcaaagcgctggatttgcgggaactgtagggaagtctggaacagggtatgcagcatatggaagccggttttatccgcggcgaaccaggtacgctcgattttcataccaccgaagcgacgcacgttaacgctaccgtccggacggcggctccacgggcagccccattgctccagctgcgtcatctcagtgggacaatggtggacaaagtaatccacgacatcctgctcacacagccagtctccgcctgctaccgtatcgtgaaaatggtagtcaaagctgtcatgatcctgggcgacagcggctgaacccccttcggcagcgacggtgtggctgcgcatcgggtacacttttgagatcagtgcgattttagcattgggattcgcctgtgcggcagcaattgcagcacgtaatcccgcgccaccagcgcctataatggcaagatcggcttgaaaggtttgcacgacattcctccagattattgtaatttcaccctcgcgcagccagataaagcctctgggttctgcgaagtatgaatgcgtttccactgctcctttatgggtacaacagtatagtctcagggatgtgagggaaatttgacgtgttcgatttttttagcgtatcagagggatgaattatcattgattttgattaatttaattactaaaccatctgaaatcactttttttaccctccagaaggcacccgatacgcctgcgcaaaatttgtttcgcccgcgcgttgcgagtagacttcgtgaccttgtcttaaactggagaaagaatcatgagcgaaacggcaacctggcagccgagcgcgtccatccccaatttattaaaacgtgcggcgattatggcggaaatccgtcgtttctttgccgatcgtggagtgcttgaggttgagacgccctgcatgagtcaggcgacggtcacagacattcatctgttcccgttcgaaacgcgtttcgtcggacctggccattcccaggggatcaacctctatttaatgaccagtccggaataccatatgaaacgcctgctggcggcagggtgcggtccggttttccagctatgccgcagtttccgtaatgaagagatgggacgacatcataatccggaattcaccatgctggagtggtatcgcccgcattacgatatgtaccgcctgatgaatgaagtggatgatttgcttcagcaagtgctggattgtcaacttgcggaaagtctctcctatcaacaggcgtttctgcgccatctggagattgacccgttatcagcagataaaacgcagctgcgtgaggcggcggcaaagcttgatttaagcaatatcgccgatacggaagaagaccgtgatacgttgctgcaactgctgttcacgatgggggttgagccgcatataggtaaagaaaagccgacctttatttatcactttccggccagtcaggcatcgctggcacaaatcagtaccgaggatcatcgcgtcgccgagcgctttgaggtgtactacaaaggtattgagctggcgaatggtttccacgaactgacggacgcacgtgagcaacaacagcgctttgaacaggacaatcgtaagcgcgccgcgcgcggtctgccgcagcagccgattgaccaaaatctactggatgcgctggccgccggtctaccggattgttccggcgtggcgctgggtgttgatcgtctggtgatgctggcgctgggagcagaaagcctggcggacgtgattgcttttacggtcgatcgggcgtaaatctgaaattcactctttcgcgagataaaatggcgaaataagcgccattttgtagcatattttttcaattatcctctgtttgccacaacataaggctggaactttgatgccatttaggtatcaattctgtgttgatttttttatcgctgaccttcgtaaaaaagaaggcggcgtcaatcggtgagcggcgtctggcaaacgcgctcgagcgtaagggatggttgaatgacccacacgataaaaaagatgagccttattgggcttatcctgatgatttttacttctgtttttggttttgcgaatagcccgtcggcgttttatttaatggggtatagcgcaatcccgtggtatatattttctgccttgctgttttttattccattcgccttaatgatggctgaaatgggttccgcttatcgcaaagaagagggcgggatctattcgtggatgaataatagcgtggggccacgttacgcgtttattggcacgtttatgtggttttcatcgtatgtcatatggatggtaagtacggcggcaaaaatttgggtaccgttttctacttttgtttttggcgccgatatgacgcagcactggcgtattgcagggcttgagcctacgcaggttgtcgggctgctcgccgtcggctggatgattctggtgacgtgtgtcgccgccagagggatcaataaaattgcgcgaattacggcggtcggaggtattgccgtaatgtgtcttaatttagttttattgttagtgagtgtcgctattttgttattaaatggtgggcattttgcacaagagattaattttacctcgtcaccgaatccgggttatcactccggcctggcaatgttgtcatttgtggtatttgctatttttgcttacggcggtattgaggctgtcggcggactggtggataaaaccgagaaaccggaaaagaattttgcgaaaggtattgttttcgcggccattgtgatttcaattggttattctttggcgatctttttatggggcgtcagtactaactggcaacagatattaagtaatagcgccgttaacttagggaatatcacctacattctgatgtcgagtttaggcacgacattaggtaacgcgttaaacctttctccggaagctgcgatgacggtgggcgtctggtttgcgcgtatcaccggcctttctatgtttctggcttataccggcgcgttttttacgttgagctattcaccgctgaaagccattattcaggggacgccaaaagcgttgtggcccgcgccgatgacgacactgaacgctaacggtatgccggcgaccgctatgtggctacagtgcgtgctggtgagtctgtttattttgctggtctcttttggcggtgacaccgcatcggcgttttataacaaactcacgctgatggcgaacgtctcaatgaccttgccatacctgttccttgcgctggcatttcccttctttaaagcgcgtcaggatctggagcggccatttgttctctttaaaaccaaagcctctaccctggtcgcgacgggtgttgtggtgctggtggtgacgtttgccaacgtctttaccatcatccagccagtgattgaagctggggactgggacagcgccttgtggatgatcggcggcccgatcttcttctcgctgctggcgatggcgatttatcagaattacagcagccgcatgagcgctgatccggagtgggcggcggagtaaaggccgtatgccggataaggccccacgggtcgcatccggcgtttattgccctatggagaacgtgatgaatgatagttcgagagacccgattatcacggaagatgagattagggcactcaattttactccggaagatatccttgaaatagaaaaggttattctttcttccgttcatgttgcacgtcgaaaggttgcgatggtagtaggaatgactattggcacgttaagggatcgcgatgaggataagtggaaacatgtgtcggatatttattgcgcgtatgttgtaagatgcctcgtatttcgcggagaactggtgggttacggcgatttattccgaatgcgctatagcgaaattaacctgcctgttgccgatctggacgcataataagtccgaaaatgtctgtgagttgcgatgaaatgcccgatggcgcaagcttatcgggcctacagattaattgtcggcccgtaggccggataagacccgacggggcgcatccggcatttcttgccgggatcatgcgctacaaactccccgccgggcggctggttttacccgctgacgttaacgttctccccgtttgtttaccgccgagactctccagacgcatctggaacggcgggaacggcatatcaataccgtgctcgcggaagccagccagaatcaattggtggatctcatggcgtaatggcatacggtgtcccatttccgcggcatagatacgcagttcaaaaatttgaataccctgctggagatccaccagaaagatttcaggcggcgggttatcaagcaccaaagaacagcgctgcgccgccgtcagcagaatttgcgtcacctcttcgctattggcatccgccggcgccgggatggttaacaccacgcgcgtaacggagtcagacagcgaccagttgataaactgttcggtgataaaggctttattcggcacgataatctctttacgatcccagtcgctgatggtggtggcgcgggtattgattttggtcacgctgccggtgagatcgcgaatggtcaccgtatcgccgatacgaatcggcttttcaaacaaaataatcaggccggagataaagttagcgaaaatttcttgcaggccaaaaccaagcccaacgccgagcgcggcaaccagccattgtagcttcgaccactcaatgccgatcatcgagaaaccgaccagcccgccaatcagcattaacagatatttggtgatggtcgtgatggcgtaaccggtacctggcgttaaatcgagatgctgtaataacgccagctccagcagcgcaggcagattacgcaccaactgcgtggtgatgataaagaccagaatcgcaatgagcaccgcccccagggtaatcggctccagactttccacgccttgcaccgtagaggtgacatcccacagcgaaatattctccaggaagccgaatgccgagtggatttccgaccacagtacaattaccgatagcagggcgataagcatcagaattgagcgaaccagacgcagcgactgagcgctaatagcgtcaagatcgatttcactttcatcgatgtcgaccgcgccttccaggctggaggagtgcgccggttcttcttcgccgcgcgcgcgctgcgccagcatttccgcccgacgatgtttggcgcggtcaaaagccagtcggcgtcgttggatcagcatccagcggcgaatgacgtgataaatgaccagcaacaggaatcagatggcgaccgaggtttccagtctcgccagtagcgcctgcgccgtggccagataacccaccgccgccgccagaatcgcgataagcggcgcgcccatcaacatattccacaacaggctgttgaccatgttgtcgccgttgccttctttatcaagatagagcgggatgcccgcttttttcagactcagcgtgaccagcgccagcgcgccgcatatcaggatgaagcaaaggcggcccaacgagccggaaaactcccgatcgttaagattatcaaacatgatcactgccataatgagcggcacgatcagcccaatgctcatcaggtagtagcgcatcgctttcgctacccggtttcgcggccagccgaaatgcgccacaaacagaccattagggcgggcaaaagcggcgcaaatcatgactacccacaacagcggtactgtcgccgtcacgccatcgccgatggcgacggccagcggatacggccaggcttcctgtagaccatagccgagcgtcgcccacaagacgggcagcggcgaggcgaccagaatcgaccagaacaccgttcgcagcgtcagcgagaagtgatcctgggtgactttcccgacgcgcgaggccgagcgctcaaggaaccggttgaagtgttggcgtgaatagaggctaaacccgaccagcgccagcgcgccgaataacggcagtagcgtctctttgctggtcagcatcatgatgctggctttacctaactgattaaacgtatctaatgagataagccgacgtaaatcctgaaccaaatcaacaggccaggagagcgatagcgggctaacgtcagcggtccagaacagataacggtgggtcgcttcattaacctctttaagcgcatcctccagttggctgttggagactttcagtttggtcaactccaggatcagcgtgtcgccgccctgtaacaaagagttgagcagctcgcgctgagtgcgaagctgggcgtcaagaatctggttttgctcggcggtcagtggttgtccattggcctgacgtatttgccgtagctgcggttgcttattgagtaattcttcatagcgcatacggtgaacgcgtagctgcgccatttccgtatcaagctgctgcggcttaggcatctctggcagacgggcgacctgcgcgcgcagcgcttcgccaagcatgttggacacgccaagccattgcgactgctcccgcagcgtattgagcgcctgacgcacctgtaacgtttggctggtggcctgtcgctgctgcgaggcgaccagatccatccgctgcgcttgttgattgagcgcctgtgacagcccgcggttgactttaaattgttcgacgatgccttccggcaaaccggcgctgttttccgccagcagctcagtgctttccagcgcgcgttccgcttcacgttgacgcaggctgttgagctgattgcgcagcgcctgaagatacgcatccaattgctgactctgtttttccgccagctcggaacgcagacgagccagttcctgccggttgttggcggacagttgcgccaactccagttcgtcgactaacgcttttagtttggcggactccgcctgcatactgagactttgcgcctggctaagcgcggcacttccgcctgcggcgccgagtcgtcgctcaatctcattaagctggcggcgggcgtcgttttgctgttggggaagctggctgagcgagtcggcgatctccctgacgcgctcctgctcctgttgcgcctcgcgggttttatccagtagctggctgctaacctgcaagatctcctgatttaacgcttcggtggacatctctggcggtacgctgcgaggttcatcgcgcagattattcaactgggcgcgcaaggtggcggatagcttagggaaattatcaataacgtgttgatattgtttcgcgcgctcaagcgagccttttcgctcttcaagcgcgtttaacgcagtctggagcgcctcaacggcttccggctgagcgggtttcgccgcttttgcctgctccagttcctgcgtgatttgtttggcgtcgggggccgttgcggcgaacgcccccgtgctgaggcaccaggccatcagaaaagcgataatcaggcgcacgtcagcattctctcttgattaggtgtcgtcttttttattgtcaaccagcgggctggcgtcgtgttcagctttaatttcttctgccggcagcggagcaggttccacctccggcgcgacgaatgtttcggtcgacgtcgccagcggttggccaattttggtaacggacaggcttgccagcgacgcgatcagattcactttccccggcgcaaataagttgatgaccgtggaacccagtttaaagcgccccatctcctggcctttcaacaaggcgacagacccttcatgttcgccttctggccaggtccagcgcttgatgatgccttcgcgcggcggggtaatggtccccgcccagacggtttcgatactgccgacaatagttgcgccgaccagaatctgcgccataggcccgaactcggtatcaaacagacagataacgcgctcgttgcgggcaaacaggttggggacgttttgcgcggtcagatagttaacggagaacagatcgcccggcacgtagatcatttcgcgcaggatgccgttgcatggcatatgcacgcgatggtagtcgcgaggggagaggtaagtggtcacaaacgtgccgttgcggaacttatccgccatcaggtagttacccgccagcaacgcttcaaggctgtaattatggcctttggcctgcaaaattttatcttcttcgatacgacccaactggcttatcacgccgtcggcaggcatcaccaggatgttaggatcggtattgagcggacgcacgtcatcacgcagcggacgaacaaagaaatcattgaacgtacgatagctggcggtatccggtttttgcgcctcggtcatatcgactttgtaatactttacgaagagatcgataaccagttttgtcagccatcctgctcgtttgcttgcgccccagcccgccaggcgagtgagccatagtttcggcagaatgtattgtagcgaaagtttaaatgagtttaacaaggtagcctccaggccattgttgttcctgaaccggcagttataccggtatcctgaaaaaaggggacgattctaacgacgcctagcgtatctgtcagtcgtccgtatcagaaaagtttttacgcgtttttacctgcgccatactttcaagaattcggtgataattttcgaaacgggtttccgcaatagcgccgttctctaccgcctcgcgaatggcgcagcctggatcggcgtcatgcttgcagtcccggtatttacaatgtcccaaatagtcatgaaattcgacaaagccctgggtgatttgttccggctccagatgccataagccgaactcgcgcacgccgggggaatcaatgacatcgccgccatgcgggaaatgatacagacgagcagcggtagtggtatgttgacccagaccggagacattcgacacatcgttcgtcagaatctcgttctgtaagccgagcagagcgtttagcagactggattttccgacgccggactgcccggcaaaaatactgatgcgaccggttaacgcttcttccagcggtttcagaccatcctgcgtatggctggagaccatcagcacgcgatagccgatattgcggtagatattcatctgctcattaacgaagtccataccttcgtcgtccagcagatcaattttattgagtacgataagcggctcaacctgtagggtttcacagccgaccagatagcgatcgatgatattcagcgacagctccggcaaaatcgcggagacaataacgatttggtcaatgttggcggcaataggcttcacgccgtcgtagaagtccgggcgcgtcaataccgaggtgcgctcatgcaccgcttcaacgatgccttttacgttgacgccctctgcggcggctttgcccggacgccagacgacgcgatcgcccgtcaccagcgaacggatagtgcggcggatattgcagcggtgaacctcgccgtcagcagactccacatcggcatgcataccaaaacggctaatgacgataccttctgcaggctcgccaaacaggttgtcatcgtagtcggctttctccgcggacgtttttaaacgacgctggtgattggcgttcacacggcgctgctggcctttggagagtttatttttgctcaatcgtactggctcctggtcgcccatagtgggcaaaacatctatgatacacgcaattgtagatgaatatagtcacagtgaatgtgacctctgaagggtggaaaatagcatgagtgccgatgaaaacaacctgatttggatcgatctggagatgacaggtctggaccccgaacgcgatcgcattattgagatagccacgctagtgacggatgccagcctgaacattctggcggaagggccgacgattgcggtacatcaatccgatgcgcaactggcgttaatggatgactggaacgtgcgcacccataccggtagcggcctggtagatcgcgttaaagcaagtacgatgggcgaacgagacgctgaactggcgacgattgaatttctgaaaacgtgggtgcctgcgggtaagtcgccgatttgcggtaacagcatcggtcaggatcgtcgttttctgtttaaatatatgccggaactggaggcttacttccactatcgctatctggatgtcagtacgctcaaggaactggcgcgccgctggaagccggagattctggccggctttaccaagcagggcacgcaccaggcgatggatgatattcgcgagtcggtggcggagctggcttactaccgcgagcatttcattaagctgtgaggcgtaacatgccggatggcaacgccagagcgtctcatccggcagctctcccgccactgaattactgcgtaaaccatttctcctgcatttgcgcatattccggcgacgctttcaccttgtcgagcgcggcattaatttcttgcaatagcgcgtcgttgcctttgcgtaccgcaatgcctaacccttttccgtagtagtcaggatcgctggcgcgttcatccatgatggcgtaatccggattgttttttagccacttaccaatcgcggcgacatcgccaaacacgccctcaagacggttatttttcagatcggtaaaagcgtttagatagctgtcataggcgacaggcgtgatagcttgttgtttatcctgcaaatagcgctgatgcgttgtaccgttttccagtccgacttttttgcctttcagatcggcaaaagtgtgataagcccctttacgcgtgacgactaccgccgataaaccttcgtaatagggttggctaaaggagacctgctgctcacgtttgggcgtcatatccataccggcgatcaccgcatcaaactttttgaaacgtaggccggggatcagactatcaaagctctggttagtgaatgagcactccgcttgcatctctttgcagaccgcgttggcgacatcaatatcgaaaccaacaattttattatcggcatcgacaaactcatagggcgcataggtggcggaggtgccaaaatgtaatgttctggcggaaacggaagcagcgtgaacggagaggctggctaacagcatgacaataagttttttttcatcttgatccctgatatcaattggatgttgtggtcaccgtgctattctttttttggcgcagggtgctattctgattctgtgcctttaggcgtggcgtgaaaagttttttgttgcatagcgcacgctttgctcgttttttgtcttgtttggtgatttaatcagcattcaaacaaaaatcgcgaaaaaatgcgttcaggggcttgcagctaaatggatttctcgtataatgcgcctcccgtaacgacgcagaaatgcgaattacgacagcaacaaatttgcgggaatagctcagttggtagagcacgaccttgccaaggtcggggtcgcgagttcgagtctcgtttcccgctccaaaatttgaaagtacttgttaagtacaaaccaccaatcgcaggatttcgaattgcgacaaggcggcaactgaatgagtcctcaggagcttactgaagtaagtgactcaggcgagtgaaggcagccaaggcagtagcggttcgaaagacgaagattatgcgggaatagctcagttggtagagcacgaccttgccaaggtcggggtcgcgagttcgagtctcgtttcccgctccaattcttatctacagtaaaattatccacaacgaatatcgcgttggggcacgttttgttccgctttcgtcagatccttgtaaacagacttatccacaggacggcccattactcctggaatgcaaaaaattatacctgacgcgtagaatttctataatttactgaaaaatatagaaaaaataagatttcaaaacgttagcgttattgtctgttccttttttccctcttgaatcgcaatgtgtttttatttttatacacagcctgtgaataattcaggcatcgcgcaccagccctttttcaatcaccctgaccagacgctgttttttcggtagctgcacttcaatgatgcaggcgttccgcttttcaatttgttgcgcaatcgcccattcgatattctcatcaagaagtggatgctcacccttgcggctttccaacgccgtaatgacggcattactccacggcgcattccccagcgcaacggcaacattgcgcagccagcgtaaatggccaatgcgccgaatcgcagaaccttcagtgactttcagaaactgcgcttcgctccagctaaacaactcaagcaaatctgggttatgcagcgccttgcgtgggctaaaatctgcttcgtcggtcaactgagagtaacgattccacggacagataagctggcagtcatcgcagccgtaaatacggttacctatcagtgggcgaaatgcttccggaatagcgccttccagctcaatggtgagataagaaatacagcgccgcgcgtccaccgtatacggttcgacaatcgccccggtcgggcaaatggtcatacaggcgacgcatttgccgcaaccttcctcgaccggctggtcgaccggcagcggtaaatcaatcagcaattcccccaggaaaaagaatgagcccgcctcccgattaaggataagtgagtgcttacccgtccagccaagtccggctttttccgctaatgggcgttcaagaataggcgcagagtcgacaaacggtctaaaattcagcgaaccgcagtactgctggatctgctcgcccagttttttaagacggctgcgtaacagcttgtgataatcacgccccagcgcatatcggctaacgtagcccagcgtgggatccttcaacgtactggcaaacgcggcgttggcgggcagatagttcatgcgcacgctgatgacacgtagcgtaccgggtaagagttcatgaggccgggcgcgcatcataccgtggcgcgccatccatgccatctcgccgtggtattgtttgtccagccacgcctgcagcgcaggttcggatgcgcgcagatcggtatcagtaataccgacctgctgaaagcccagctccagcccccactgcttaatattttgcgctaactgattgagatcgaggggctttgacatgatggaccataacatgaagaaaaaccctgtaagtataccacactccatttggcccgccgatgacatcaaacggctggaacgcgatgcggcggatgccttcggactcacactctatgaattgatgctgcgcgctggcgacgcggcatttcgggtagcccgtgacagttaccctgacgcccgacactggctggtgttgtgtggtcatggcaacaacggcggcgatggttacgtcgtggcgcgactagcgcaagcggcgggcattagcgtaacgttgctggcgcaggagagcgacaaaccgttacctgaagaagcggcgcaggcgcgcgatgcctggctgaatgccggcggcattatccatgctgccgatattatctggccggaagcgacggatctgattatcgacgcgctgcttggcaccggcatagcccaggagccgcgcgatccggtagccggtctgattgaacaggcgaacgcccatcctgcgccggttgtcgccgtcgatatcccgtcaggcctgctggcgcaaacgggcaccacgcctggcgcggtgataagcgccgcgcatacggtcacgtttatcgccctgaaaccaggcctgctgaccggcaaagcgcgtgacgttaccggcatattgcattatgacgcgttggggctggaaggctggctggcgagccagacgccgccgctccggcgttttgacgcgacgcagttggggcaatggttaacgccgcgtcgaccgacctcgtataagggcgatcatggtcgtctggcgattatcggcggcgatcagggaacagcgggtgcaattcggatggctggcgaggcggcgctgcgtacgggggctgggttggtcagagtactgactcgcggtgaaaacatcgcgtcgttgctgacggcccgcccggaactgatggtacatgaactcacgcctcagtcgctggaagagagcctgacctgggctgacgttgtggtgatcggcccggggcttggacagcaggaatggggcaaaaaagccttacagaaagtagaaaacgtccgtaaacctatgctgtgggatgcggatgcgttgaacctactggcaatcaatcctgataaacgtcacaatcgcgtgattacgccgcatccgggagaggcggcccgcctgttaggatgttctgtggcagaaattgaaagtgatcgcttactttcagcacagcgtctggtaaaacggtatggaggcgtggtcgtgttaaaaggcgcaggaacgattattgccgctgaacaccaccctctggctatcattgacgctggtaatgcggggatggcgagcggcgggatgggcgatgtcctgtccggcatcatcggcgcattgctcggacagaagtttaccccgtatgatgcggcatgtgtgggatgtgtggctcacggcgcggcggcggacttactggcagtgcgttatggcgctcgcggcatgttggcgaccgatctttttactacgctgcggcgtattgttaaccctgatgtgattgacgtaaaccatgatgaatcgagtaattccgctacctgacgaacaggcgacgctagacctggggcaacgggtagccaacgcctgtgatggcgcgaccgttatttatctgtatggcgatttaggtgccggtaaaacgacgtttagccggggatttttacaggcgttaggccataacggtaatgtaaaaagccccacctatacgctggtagagccttatgcgcttgataacatgatggtatatcacttcgacttataccgtcttgcggacccggaggagctggagtttatgggcattcgcgattatttcgccaacgacgccatttgtctggtggagtggccgcaacaaggtaaaggcgttctccccgacccggacgtcgaaatccatattgattaccaggcgcaggggcgtgaggctcgcgtaagcgcggtatcctcatcgggtcattcgttactggcgcgtttagccgattagctataaaggtggcgggatgatttatcgcatcaaaaatgccgtaatagcagccttaatcctgctgtgcgcgcaggcgggcgccgccagtctctctgatattcaggtgtccaacggcgagcagcaggcgcgcattacgctgagttttatcggcgagccggaatatgcttactcacaggacggtaaacggaccgtggcgctggatatcaggcagaccggcgtgattcaggggctgccgcttcagtttagcggtaacaatctggtaaaaacgatccgtgccggaacgccgaaagatgcgcaatctttacggctgcttgtcgatctgacggaaaatggtaaaaccgaggcggtgaagcggcaaaacggcggcaactatacggtcattttcaccattaatgccgatgttccgccgccgccaccgcctgtcgtcgcgaaacgggttgaaagcgcgccccgcccgacggagcctgcccgtaatccgtttaaatcttctgatgatcgcctgaccggcgtaaccagcagcaacaccgttacgcggcctgcggcgcgcgcgtcggcaggcgctggcgataaagtggtgattgctattgatgccggacatggaggccaggaccccggtgcgataggcccgggcggtacgcgcgagaaaaatgtcaccatcgccatcgcgcgtaagttacgcacattgctgaataacgatccgatgtttaaaggcgtgctgacgcgtgacggcgactattttatttcggtgatggggcggtctgatgtggcgcgtaagcaaaacgccaacttccttgtctctattcatgcggatgccgcgccaaatcgcgacgccaccggcgcctccgtctgggtattgtccaatcgtcgcgcgaatagcgaaatggcaaactggcttgagcagcatgagaagcaatccgaactgttaggcggcgctggcgatgtgctgacgaacagtcagtcagacccttacctgagccaggcggtactggatttgcaattcggtcattcgcagcgggtagggtatgatgtggcgacgaacgtactaagccaactcgacggcgtggggtcgctgcataaacgtcgcccggaacacgcgagcctgggcgtgctgcgttcgccggatatcccgtccattttggtggagacgggttttatcagtaatcacggcgaagaacgattgctggcgagcgaccgctatcagcagcagattgctgacgctatataccgggggttgcgtaagtactttgcagcgcatccgatccagtctgcgccgcagggcagcccaggccagacggccagtaccaaccagcctggcgctataaccgccgcgaattaaggagatttcatgccgattcaggttctgccgccgcagcttgcgaaccaaatcgccgctggcgaagtggtggaacgccctgcgtcggttgttaaagagctggtagagaatagtctggatgcaggcgccacccgcgttgatatcgacatcgagcgtggcggcgcgaagcttattcgtattcgcgacaatggctgcggcattaaaaaagaggagctggcgctggcgctggcccgtcatgccaccagtaaaatcgcctcgcttgacgatctggaagcgattatcagtctgggatttcgcggcgaagcgctggcgagtatcagttcggtctcgcgtttgacgctaacgtcgcgcacggcggagcaggcggaagcctggcaggcgtatgcggaagggcgcgacatggacgtgacggtaaaacccgccgcgcacccggtcggcaccaccctggaagttctggatctcttttataatacgcccgcccggcgcaaattcatgcgtaccgaaaaaacggaatttaatcacatcgatgagatcatccgtcgtattgcattggcccgttttgacgtcacgcttaacctgtcgcacaacggcaaattggtacggcagtatcgcgctgtcgcaaaggacgggcaaaaagagcgccggttaggcgccatctgcggcacgccgtttctcgaacaggcactggcgatcgagtggcagcatggcgatctgaccctgcgcggctgggtcgccgatccgaatcacaccaccacggcgttaacggagatccagtactgctatgtgaatggccgcatgatgcgcgaccgcttgatcaaccatgccattcgccaggcctgtgaagataaactgggcgcggaccaacagcctgcgtttgtgttgtatctggagattgacccgcatcaggtggatgtcaatgttcatcccgccaagcacgaagtgcgttttcatcaatcgcggctggtgcacgacttcatctatcaaggggtgctgagcgttctacaacagcagacggaaacgacgctgccgctggaggagattgcgccagcgccgcggcatgtcccggaaaaccgtatcgccgccgggcgcaaccattttgctgtacccgccgagccaactgcggcgcgcgagcccgcgacaccgcgttattccgacggcgcatcgggcggtaacggcgggcgtcagtccgcaggtggttggccgcacgcgcagccaggctatcagaagcagcagggcgaggtttatcgcacgcttttacagacgccgacgacgagccccgcgccggagccggttgcgcctgcgcttgacggacatagccagagttttggtcgcgtactgacgatagtcggcggtgactgcgcgttgctggaacacgcggggactatccagctcttgtcgctgccggttgcggagcgttggctgcgtcaggcgcagcttacaccgggtcaaagtccggtttgcgcgcagccgttgctgattccgctgcgtttaaaagtgagcgccgatgaaaaagccgcgctgcaaaaagcccaatctttgttgggagaattgggtattgaatttcagtcagatgcgcagcatgtgaccattcgggcggtgcctttacccttacgacaacaaaatttacaaatcttgattcctgaactgataggctacctggcgcaacagaccacatttgcaacggtcaatattgcacaatggatagcgcgtaatgtgcagagcgaacatccgcagtggtcgatggcgcaggccatatcgctgctggcggatgttgagcggctatgtccgcagctggtaaaagcgccgccgggtggcctgttacaacctgttgatttacattcggcgatgaacgccctgaagcatgaatgatgtaagcaaggtgagcctgcctaaggcgatatttttgatggggccgacggcctccggcaaaacggcgctggcgatagaactgcgtaaagttttgccagtagagttgataagcgttgattccgccctcatttatcggggaatggatattggcacggctaagccgaatgccgatgagctgaaagcggcgccgcatcgactgctggatatacgcgacccgtcgcaggcgtattcggcggcggattttcgccgcgacgcgttagcgcaaatggcggagatcaccgctgcggggcgtatcccgctgttagtgggcggtaccatgctgtattttaaggcattgctggaagggttatcgccgctgccttcagcagatccggaagtcagatcccggatagagcagcaagcagcggagcttggatgggaggcgttgcatcagcaacttcaggagatagatccggttgccgccgcgcgaattcatccaaatgatccgcaaagactttcccgggcactggaagtttttttcatttcgggtaaaactttaacggagctaacgcaaacgtcaggagacgcgctaccgtaccaggtgcatcagttcgctatcgccccagcgagccgtgaactgctccatcagcgcattgaactgcgttttcatcagatgttggcttcaggttttgaagcagaagtccgggcgctttttgcccgagaagatttgcatacggacttgccttccatccgttgtgtgggataccgccagatgtggtcatacattgagggcgaaatctcatatgatgaaatggtttatagaggtgtttgctccacgagacagttggcgaagcgccagatgacctggttgcgcggttgggaaggggtgcgctggcttgacagtgagaatcccgatcgggcgcgaaaagaagtattacaggttgttggtgctatcgcagactgaatgtgtacaattgagacgtatcgtgcgcaatttttcagaatcgaaaggttcaaagtacaaataagcatataaggaaaagagaatggctaaggggcaatctttacaagatccgttcctgaacgcattgcgtcgggaacgtgttccagtttctatttatttggtgaatggtattaagctgcaaggtcaaatcgagtcctttgatcagttcgtgatcctgttgaaaaacacggtcagccagatggtttataagcacgcgatttctactgttgtcccgtctcgcccggtttcccatcacagcaacaatgccggtggcggcgccagcaataactaccatcacggtagcaacgcgcagggttctactgcgcaacaggacagcgaagagactgaataagttcacgcgctgtttatccatgtcgggggcgtcggataatcgcccccgctggttattaagagggtttacgcttgtttgaccgttatgatgccggtgagcaggcggtactggtacacatctatttttcgcaagacaaagatatggaagacctccaggagtttgaatctctggtctcttccgccggtgtcgaagcaatgcaggtgattaccggtagccgtaaagcaccgcacccgaagtactttgtaggtgaaggtaaggcagttgaaattgcggaagccgtgaaagcgactggcgcagcggtcgtattgtttgatcatgcattgagtccagcccaggagcgaaacctggagcgtttgtgcgagtgccgggttatcgatcgcaccggtcttatcttagatatttttgcccaacgtgcgcgtacccatgaaggtaagttgcaggttgagctggcgcagctacgccatctggctacgcgtctggtgcgtggctggacccaccttgaacgtcagaaaggcgggattggtttgcgcggtccgggtgaaacccagctcgaaaccgaccgtcgtttactgcgtaatcgcattgtgcagattcagtcgcgcctggagaaagttgagaagcaacgtgagcaggggcggcagtcgcgcatcaaggccgacgttccgacggtatcgctggtgggctataccaacgccggaaaatccaccctttttaatcagatcactgaagcgcgggtctatgcggcagatcagctatttgcgacgctggaccccacgttacgtcgtattgatgtagcggatgtcggtgaaaccgttctggcggatacggtaggctttatccgccatttaccgtacgatctggtggctgcctttaaagctaccctgcaggagacgcgtcaggcgacgctgctgctgcatgtggtcgatgcggcggatgttcgtgtgcaggaaaacatcgaggcggtaaacaccgttcttgaagagattgacgctcacgaaatccccaccttaatggtgatgaacaaaatcgatatgctggacgactttgaaccgcgtatcgacagagatgaagagaataaacccatccgcgtttggctttcagcgcaaagcggcgtgggaataccacagctttttcaggctttgacggagcgtctttccggtgaggtggcgcagcatacgctgcgtttgctgccgcaggaagggcgtctgagaagccggttttatcagcttcaggcaatagaaaaagagtggatggaggaagacggtagcgtcagtctgcaggtacgaatgccgattgtcgactggcgtcgcctctgtaaacaagaaccagcgttgatcgaatacgtgatctagacgcgaagtcattcaggtcgtattgaagcggtagctgagagaatttcaggagctcacaacgaagtgacctggggtaaaaaagccgccactcaaggcgtagcctgaaagatgatgtctgtaacggcggttcgtctgaagcatggagtaatttcgccttatcctctgaggtcgaaagacaacggggatcaccgcataacaaatatggagcacaaacatggcgtggaatcagcccggtaataacggacaggaccgcgacccgtggggaagcagcaaacctggcagcaactctgggggaaatggaaacaaaggtggccgcgatcagggacctcccgatctggatgatatcttccgtaagctgagtaaaaaactcggtggttttgggggcggtaaaggcaccggttccggcggcggtagctcatcgcaaggcccgcgtccgcaactgggaggccgtattgtcgccatcgccgcggcggcagtagtcattatctgggcggccagcggtttttataccattaaagaagccgagcgcggcgttgtgacgcgttttggtaaattcagccatctggtagagccaggtctgaactggaagccgacatttattgacgacgtcacgccggtgaacgtcgaagcggtgcgcgaactggcggcgtcaggcgtgatgctgacgtctgatgaaaacgtcgtgcgcgttgaaatgaacgtgcaataccgcgtcaccgatccgcagaaatatctgtttagcgtgaccagcccggacgatagcctgcgtcaggccaccgacagcgcgttgcgtggcgtcattggtaaatacacgatggatcgcattctgaccgaaggtcgtaccgttattcgtagcgatacccaacgcgagctggaagagactatcaaaccgtacaacatggggattaccctgctggacgtgaacttccaggctgcgcgtccgccggaagagatgaaagccgcctttgacgacgcgattgccgcacgtgaaaacgagcagcagtacattcgtgaagcggaagcgtataccaacgaagttcagccgcgcgccaacggtcaggcgcagcgtattctggaagaggcacgtgcctataaaacccagactatcctggaagcgcagggtgaagtcgcccggtttgcgaagattttgccagaatataaagccgcgccgcagattacgcgcgagcgtctgtatattgaaacgatggaaaaagtgctgagccatacccgtaaagtactggttaacgacaagagcggtaatttaatggtgctgccgttagatcagatgctgaaaggcgggaatgcgccggcggcaaagagcgacaatagcgccagcaacctgctgcgcctgccgccgtccacaaagtctaacgccagcggagcaagcaacacgtcgtcctcaaatcagggcgatattatggaccaacgccgcgcgaatgcgcagcgtaacgactaccagcgtcagggggaataacgatgcgtaagtcagttattgcgattatcatcatcgtgctggtagtgctctacatgtccgtctttgtggtcaaagagggcgagcgcggcattacgctgcgttttggtaaagttctgcgtgacgatgagaacaaaccgctggtttacgcgccgggtctgcactttaagatcccgtttattgaatcagtgaaaatgcttgatgcgcgtatccagacgatggataaccaggccgatcgctttgtgactaaagagaagaaagacctgattgtcgactcctacatcaaatggcgtatcagcgactttagccgttactatctggcgaccggcggcggcgatatttcgcaagccgaagtgctgttaaaacgtaagttctcggaccgtttgcgttctgagattggtcgcctggacgtaaaagacatcgtgaccgattctcgtggtcgtctgactctggaagtgcgcgacgcgctgaactccggttcagccggcactgatgatgaagtggcgaccccggcggcggatgacgcgattgccgaagcggcggaacgcgtcacggcggaaaccaaaggtaaagtaccggtcatcaacccgaacagtatggcggcgttgggtatcgaagtggtcgatgtgcgtattaagcagatcaacctgccgaccgaggtttctgaggcgatttacaaccgtatgcgcgccgagcgtgaagcggtcgcgcgtcgtcatcgctcacaaggtcaggaagaagcggaaaaactgcgtgcggctgctgactatgaggtgacgaaaactctggcggaagccgagcgtcaggggcgtatcatgcgtggtgaaggtgatgctgaagccgcgaagctgtttgccgacgcgttcagccaggaccctgatttctacgcgttcattcgtagtctgcgcgcttacgagaagagcttcgaaggtaatcaggacgtgatggtactgagcccggacagcgatttcttccgctacatgaagacaccgagttcgacgacacgctaaaatagcgtcagcggttttagaccagcaaaaccaccgcatccaaaggatgccggtggttttcttttataagggcgataaatgaattcaacaatctggttggcgcttgctctggtattagtcctcgaagggctgggaccgatgctgtatcccggcgcatggaaaaaaatggtttcggcactggcgcaactgccggaaaatgttttacgtcgttttggcggcggacttgtggtcgcgggagttgtggtctactacatgttgaggaaaacgattggctgagcaaaaagtggtcggatttgccgcagattgagtgcaaaaagtgctgtatatctgaaaaagcgatggtagaatccatttttaagcaaacggtgattttgaaaaatgggtaacaacgtcgtcgtactgggcacccaatggggtgacgaaggtaaaggaaagatcgtcgatcttctgactgaacgggctaaatatgttgtacgctaccagggcggtcacaacgcaggccatactctcgtaatcaacggtgaaaaaaccgttctccatcttattccatcaggtattcttcgcgagaatgtaaccagcatcatcggtaacggtgttgtgctgtctccgagcgcgctgatgaaagagatgaaagaactggaagaccgtggcatccccgttcgtgagcgtctgctgctgtctgaagcctgtccgctgatccttgattatcacgttgcgctggataacgcgcgtgagaaagcgcgtggcgcgaaagcgatcggcaccaccggtcgtggaatcgggcctgcttatgaagataaagtggcacgtcgcggtctgcgtgttggtgaccttttcgacaaagaaacctttgctgaaaaactgaaagaagtgatggaatatcacaacttccagttggttaactactacaaagctgaagcggttgattaccagaaagttctggatgatacgatggctgttgccgacatcctgacttctatggttgttgacgtttcagacctgctcgaccaggcgcgtcagcgtggcgatttcgtcatgtttgaaggtgcgcagggtaccctgctggatatcgaccacggtacttatccgtacgtaacttcttctaacaccactgcgggtggcgtggcgaccggttccggcctgggcccgcgttatgttgattacgttctgggtatcctcaaagcttactccactcgtgtaggtgcaggtccgttcccgaccgaactgtttgatgaaaccggcgagttcctctgcaagcagggtaacgaatacggcgccactaccggccgtcgtcgtcgtaccggctggctggacaccgttgccgttcgtcgtgcggtacagctgaactccctgtctggcttctgcctgaccaaactggacgtgctggatggcctgaaagaggtgaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactacatcaaacgtatcgaagaactgaccggcgtgccgattgatattatttctaccggccccgatcgtactgagacgatgattctgcgcgatccgttcgacgcgtaattgatggatgatgcccggtaacgctacgcttaccgggtctatgatgagtacgcatttgttggccggataagatgctttgcatcatgcacttcggctcaaatgcgtcattgttccccgcttttttccttcctgaaccgaaataaattagcagcctgacaggtggctggtttatcatcaatacagataagttatatcccgttttcccttttcctgaggttgatgtgcagttaacgagtttcaccgattacggcttacgtgcgctaatctatatggcgtcgttaccagatggacgaatgaccagcatttctgaggtgacagaagtctacgacgtgtcccgtaatcatatggtcaaaattatcaatcagcttagccgggcgggctttgtcaccgccgttcggggaaaaaatggcggtatccgcctgggtaaaccggctaatactatttgtattggcgatgtggtgcgtgagctggaacccttatcactggtcaactgtagcagcgaattttgccacatcacccctgcctgtcgtctgaaacaggcgctttctaaggccgtgcagagttttctcaaggagctggataactacacgcttgccgatttggttgaagagaatcaaccgctttataaattattactggtggagtgaagtaaacttcattagagatgacaatggaggaacctcaatgtcacaagatcctttccaggaacgcgaagcagaaaaatacgcgaatcctatcccgagccgggaatttatcctcgaacatttaacgaaacgtgaaaaaccggccagtcgcgaagaactggccgtagaactgaatattgaaggcgaagagcagcttgaagccttgcgtcgccgcctgcgcgcgatggagcgcgatggacaactggtctttacccgccgccagtgctatgcgctgccggaacgcctcgacctgctgaaaggcaccgtgatcggtcatcgtgatggttacggtttcttacgtgtcgaaggccgcaaagacgatctgtatctttccagcgagcagatgaaaacctgtattcatggcgatcaggtgctggcgcagccgctgggcgccgatcgtaaaggtcgccgcgaagcgcgtatcgtccgtgtactggtaccgaaaaccagtcagatagtcgggcgttatttcaccgatgcgggcgtcggctttgtggtgccggacgacagccgtctcagcttcgacattcttatcccgccagaagacgtcatgggcgcgcggatggggttcgtggtcgtggttgaactgactcaacgtccaactcgccgtactaaagcggtagggaaaatcgtcgaagtgctgggcgacaatatgggtaccggtatggcggttgatatggcgctgcgtacccatgaaataccctacatctggccgcaggcggtagagcagcaggtcgccgggctgaaagaagaggtgccggaagaggcgaaagtcggtcgtgtcgatctgcgcgatttgccgctggtcacgattgatggcgaagatgcccgtgactttgacgacgcggtttactgtgagaaaaaacgcggcggcggctggcgtttgtgggtcgctattgctgacgtgagctattatgtacggccgccaacgccgttggatcgcgaggcgcgcaatcgcggcacgtcggtttacttcccgtcacaggttgtcccaatgttgccggaggtgctctccaacggcctgtgttcgctaaacccgcaggttgacaggctgtgtatggtctgtgaaatgaccatctcggcgaaaggtcggctgaccggctacaaattctatgaagcggtgatgagctcccatgcgcgtctgacctataccaaagtctggcatatgctgcagggcgatcaggatctgcgtgaacaatatgcgccgctggtgaagcatattgaagagctgcacaacctctacaaagtgctggataaagcgcgtgaagaacgcggggggatctcgtttgagagcgaagaggcgaagtttatctttaacgccgagcgtcgcattgagcgtatcgaacagacccagcgtaatgacgcgcataagcttatcgaagagtgcatgatcatggcgaatatctcggcggcgcgctttgtcgaaaaagctaaagagccggcgttattccgtattcatgataagcccaccaccgaagcgatcacctcattccgctccgtactggcggagctggggttggagctgccgggcggaaataaaccggaaccgcgcgattatgccgaactgcttgaatcgattgccgacaggccggacgccgaaatgctgcaaactatgctgctgcgttcaatgaagcaggcgatttacgatccggaaaaccgcgggcactttggcctggcgttgcagtcttatgcgcactttacctcgccgattcgccgctatccggatctttctttgcaccgcgccattaagtacctgctggctaaagagcaagggaacaagggcaacaccacagaaacgggcggttatcactactcgatggaagagatgttgcagctcggccagcactgttcgatggcggaacgccgcgctgatgaagcgacgcgtgatgtctccgactggctgaaatgtgactttatgctggatcaggtaggcaacgtctttaagggcgtgattgccagcgtcaccggtttcggcttctttgtccgtcttgatgaactgtttatcgatgggctggtacacgtttcctcactggataacgattactatcgcttcgatcaggtagggcaacgtctgattggcgaatccggcgggcagacatatcgcctgggcgaccgggtcgaggtacgcgtcgaagcggtgaatatggacgaacggaaaattgactttagcttgatttccagcgagcgcgcaccgcgtaacgtcggcaaaacggcgcgtgaaaaagcgaaaaaaggtgaaagtaaaaacgccggtaaacgtcgtcaggtaggtaaaaaggttaacttcgagcctgatagcgccttccgcggcgagaaaaaagcgaagccgaaagcagcgaagaaagacgcgagaaaagcaaaaaagccatcggctaaaacgcagaaaatagccgcagcgaccaaagcgaagcgtgcggcgaagaaaaaagcggcagagtgagcaataccctcttcaaacagaagagggtcaattatctgtaggccgggcaagcgtagcgcccccggcaaaacgtaaacaacgagtacattaatgagcgaaatgatttacggcatccacgcagtgcaggccctgctggagcgcgcccctgaacgttttcaggaagcctttattttaaaaggccgtgaagataaacgtctgttgccgctgattcacgcccttgagtcccagggcgtggttatccagctggcaaaccgccaatatctcgacgagaaaagcgacggtgccgtgcatcagggcattatcgctcgtgtgaaaccaggccggcagtatcaggaaaacgatctaccggatctgatcgcattacacgatcgcccctttttgttgatcctcgatggcgtcaccgatccgcataatcttggcgcctgtctgcgcagcgccgatgctgcaggcgtacatgcggtaatcgtgccgaaagaccgctccgcgcaacttaacgcgacggcgaagaaagtcgcctgcggcgcagcggaaagcgtgccgttgatccgcgtcaccaacctggcgcgcacgatgcgcatgttgcaggaagagaatatctggattgtcggaacggcgggcgaggctgaccatacgctgtatcagagcaaaatgcctggccgcatggcgctggtcatgggcgcagaaggtgaaggtatgcgtcgtctgacccgtgagcactgcgatgagctgatcagcattcctatggccggtagcgtgtcatcgctgaatgtctctgtggcgaccgggatttgtctgtttgaagccgttcgccagcgtacctgacgctaatagtattttttaagaaaaaaccatccataatcggatggtttttttttatctttggctggtaatataaaaagcaaaacctaccctgtaactccctttatttataaaaaagagatagagataataatatggcatggactccacggacgctggcggatgcgttaaacaacatcgccgaattagatattgatatagaaaataatgaatcttcattaataataaaaatgaatgattatggcgatttaccactgacggttttatttacctcgcaacaaatagttatcgagacttatatctgtccggtaaatacgattagagataccgcggaatttaatcttttcttgctgagaaatcagaaggttttaccgctgtcttcggtcggtattgccctggtaaaacaggaggaatattatgtcgcttttggcgcgttgtcgttaaattcgtcgcttgccgacgtgacgctggaaatcaccacgcttgtagaaaatgcgttggatatcgctgaaataacacaagtctattcacaggaataatacaggcggcttacatgggaattttaaaaagtttgttcacgttaggtaaatcattcgttgctcaggcagaagaagccattgatgaagcacagggtgtacgtatgctggagcagcatattcgcgacgcaaaagccgagctggataaagcgggtaaatccagagtggatttattggcgcgggtgaagctaagccatgacaagctgaatgatttacgtgcgcgtaaagtcagccttgaaacgcgggcgttggcggcaatgagtaagaatgtcgacgccgctttactcaacgaagtggcggaagaaatagcccgtctggaaaatgccattcttgccgaagaacaggtgctgactaatctggaagcctctcgtgatgcagtggagaaggccgtaacggcgacaggccagcggattgcgcagtttgagcagcaacttgaagtggttaaggcgacagaagccatgcagcgcgcgcagcaggcggtgacgacttcgaccgtcggagccgcgtcgaatgtgtctacggcggcggagccgcttaaacgtttacaaacgcgtcaggctgaacgctaggcacggctggatgccgccgcgcagctggaaaaagtcgccgatggacgcgacctggacgaaaaactggcgcaggcgggtattggcgcaaccaataaaagcaatgctcaggatgtgttggcgcgtttacagcgtcaacaaggcgaataatgctctttacgtggatggtcaaaacctgccagcgtcatttgtccagactgacctggcccgctttgctgggcctgtttatcgggcagtatctgctttgctatctgtagcgcgaaagcgcgctaccgtgctgagcttcgtcgctttcatacgagacggcacatgaatgcgcgatctcaaatgacattatgcccaacgacaatcgcattctgtctgaagaggtcgcatggcaagagatagaggttcccctatgatgcaattttttcagcgtttgctcggtaaaacaagcacgccagcgccgattcgcggaccattaggattacatcttaacgccggtttcacgctggatacgctggcattccggctactagagtcgtcgttgctggtggcgctaccaggtgaaaaatacactgtcgcggcagcgagtcgcatagatttaggcggcggcagtcagatttttcgctactacacctctggcgatgagtttctacaaattaacaccactggcggcacggatgttgacgacattgatgacatcaaactttttgtatatgaggaaagtttcggtattaacgaggaacgtcactggcgttcagccattgcgccagcggcaatagggccgatgacgctcaactggcaagaacggcgctggcagcgcttttttaaccatgaagagccgggcaatattgaacttgtctacatgctggaaaaggttgaaaatcagcaggcagagaaatgggacgttcacaattttacgatgggtttccagcgccaggtgacggacgacgcctgggagtatcttctattgaacggggaagaatcatttaacgagcgcggtgagcctgaatgggtgttttcacgcgccctcggcgtggatatccctctcacttcactaacggttattggttaagcacatacagggaaattatgcatatactggacgcattactggctttctgcgcctatttttttattggcgcggcaatgatcattgtatttctttttatttactcaaagataacgccgcataatgaatggcagttgataaaaaataacaatactgcggcatcgctggcctttagtggtacgttgctgggctatgtcatccccttatccagcgcggcgataaactcagtcagcatcccggactattttgcctggggcggcattgcgctggtgattcagctgctgatttatggttgcgtaaggttatacatgcctacgctgagcgaaaaaattattcatcacaacgtggcggcggggctatttatgggaaccgcagcgctggctggcggtatttttaacgctgcctgtatgacatggtaacggaagatcatggcaaaaaaacgaaaatccagaagcacatccggcgtaggccattcggcaataagacggatagccgaaccggtcaatccctttgagcggcaacgaaatcgctacacgccaaaatacctgacgctggcgattatgggtggagcggccttttttctcctgaaagggtacggtgacggcagcaatagtgacaacgacggcgatgggacgttttacgccacggtgaacgactgtattgacgatggcaatagcgccagcgtttgcgctgacggctggaataatgcgaaaacagaattttacgctaatgtgcctaagcaattgacgcaggagagctgtcagtcgcagtttggcgattgctactttgatatcaccgagcggagctgggttccggtattaagcggctttttactcagccgcgcgattcgtcagaaccgtgatgaacaatacatctatagcagcggcggttcatcttacgtctcccgtcccgtctggcgcaccacatccggcgattatgcgtggcgcagcggcacagggaaaagcgataccgtgaccagccctggttatatcatacggaaagcgtccaccgtctcccgcggcggctatggccgttcttccagcgcccgcgggcactggggaggctaaccatgctacgacataacgtaccggtacgccgggatctggataagatcgcatgcgatcacggttttgactttcatgttatcgataacgaaatttactgggatgaaagccgggcctaccgttttacattacggcaaattgaagaacagatcgaaaaaccgaccgcagagcttcatcagatgtgtctggaggttgtcgagcgggccgtccgggatgagcagatcatgcagcagctggcgatcccgccattgtactgggatgtcatcgccgaaagttggcgcagccgcgatccttcgctttacgggcggatggatttcgtctggtgcggcaaagatccggttaaattgctggaatacaacgcggatacgccgacatcgctctatgagtcctcctactttcaatggctatggctggaggatgctcgtcgtagcggcgccatcccgcgtgatgccgatcaatacaacgcgatacaggagcggctgatcgcccgcttcagcgagctgtacagtcgggaaccgctctacttttgctgttgtgaagataccgacgaagatcgtacgacggtgctgtaccttcaggattgcgcgcagcaggcgggccaggaaacgcgatttatctatattgaagaactggggcttggcgtaggcggcgtgctgaccgatctggacgataacgtgattcgccgcgcctttaagctctacccgctggaatggatgatgcgcgatgacaacggcccgctattgcgaaaacgtcgtgagcaatggattgagccattgtggaaaagtattctgagtaacaaagggctgttgccgttattgtggcgctttttccctggccatccgaatcttctgccggcttggtttgagggcgaaaaatcgctcgcagcgccaggtgaaagtagcgtacggaagccgatttattcacgtgaaggcggcaacgtcacgatttttgacgagcggcaaaatgttatcgatcatgccgatggcgactacgctgacgagccgatgatttaccaggcgtttcagcctttgccgcgctttggcgatagctatacgctgattggcagttggatcattgacgatgaagcctccggaatggggattcgcgaggacaatacgctaattaccaaagacacttcccgtttcgtcccacattatattgccggttaatcatacttttgtgatcttgctccggcgtcaatggcgcagtcatgaccatacttgacttcagcgccattgaaggagggagacaccatgtcctggcaaacacataccgtctttaatcaacctgctccgctcaataacagtaacttattcctgtctgatggcgcgctgtgtgaagcggtttcccgggaaggcgcgggatgggatagcgatcttctcgccagcattggccaacaactgggaacggcggaatcactggaactggggcgtctggcgaacgcgcatcctcctgagttgctgcgttacgatccccagggacagcgcctggatgacgttcgctttcatcccgcctggcacctgttgatgcaggggctttgcgctaatagggtacattacctggcctgggaggaagaggcaagggcgggaagttttgtcgcccgggcggcgcgttttgtattacatgctcaggtagaagcgggaacactctgtcctgtcacgatgacctttgccgcgacgccgttgctattgcagatgcttcccgccactttccatgactggctggcgccgctgcgcagcgatcgctacgattcgcatttgctgccgggcgggcaaaaacggggcctgctcatcggcatgggaatgacggaaaagcagggcggatctgacgtactcagtaatacgacccacgcggagcggctggcggatgattcatatcggctggtgggacataaatggtttttctctgtgccgcaaagtgatgcgcacctcgtgctggcgcaggcaaaaggaggactatcctgtttctttgtgccgcgtttcctgccagacgggcaacggaactctgttcgtcttgagcgcctgaaagataaactcggtaatcgatctaatgccagcgccgaggtcgagtttcaggataccgtcggctggcggctgggagaagagggcgaagggattcggcatatcttaaagatgggcggtatgacgcgtcttgattgcgcgctcgggagtcatggcttaatgcggcgcgcattttcagtcgccatttactatgctcatcagcgtcaggcttttggtaagccgctgatcgaacaaccgttgatgcgacaaaccttaagtcgtatggcgctatgcctggaggggcagacggcgcttttgtttcggctggcgcgcgcctgggagcaacgtcgcgaggcgaaagaggcattatgggcgcgattattcacgccagcggcgaaattcgccatctgtaagcagggaatcccttttgtggctgaggcgatggaggttctcggcgggatggggtattgcgaagagagcgaactcccgcgcctgtaccgtgaaatgccggtgaacagtatctgggaaggttccggcaatatcatgtgtctggatgtacttcgggtgctgacaaaacaacacggcgtctatgacgtattgagtgaagcttttgcggaagtcaaaggtcaggatcgccattacgaccgcgcggtacgccagctacagcaacgtttacgcaaaccggacgaagcaatgggcagagagattacgcagcagcttttcttgctggggtgcggagcggaaatgctgcgtcatgcctcgccgccgctggcgcaagcgtggtgtcagatgatgctggatacacgcggcgaaatgccgctgcctgcccaggtgcaaaatgatttactgttaagggcgaccgggggactgcggtaacgtttggcctgtagtacatgccatccggcgcgagccacgcggcatcaggcatagagtatcgcctgtacgcgccagttattcgactgttgttcttcatacatttgaataattctgtaccaggacgcaccctgttcatcggctttgagggcgataatccgctccacatcctgtgggtttcctgcaacattactgaccgagatcaggccgatttcattcagacccgttacgcagtcagcactggcgaattcggcagactgtgccgtcgtactcaccagtccggcagaaagcagcagtgaggataaggcaagttcttgtttcatcgtcagctccttattacataccccgcatttaacaggacgctccatcacggtaaacctgtttgtttattgtgcacaggtaaacgcataggggcgcaaagcaatgtaaaactgactaaaaatcaatctactgttattgacgatataaaatggcttgtgaataccactgtccggttacaaccgtttcatcaaccattaagataacgtaataatcggctttcgcagcggcggctttcgctctgatttcatctattgcatcatccggggaaccccgaaccagcgcgcttacggtccccatccgctgtagtccttgcgtttgatcgcgacggatttcctgcgggtgatcggcgacaggcggcgcaggttgcggcgtaccctgcagtatgctacacgcgcttaataacagcgctgctatcaatggagcaaaccgacgcataactctatctcgtttcctgataatcatagtgtaatgccttattgatttccctttagggggaatgttcccgaagtgttacctgtcacgcgattttcgaatgaaaacgttgcgaaagcgtaacccagttctcaaacattatgaattattgcgctatccataaacttgcgttaagtatttctccgtggcataccggataaaaaggagagaataatgatagcgattgaaacacgacaattagccggaggcgtcgtactacatgccttcccggaagggaaacgcgccgtgccgcttccctgtgtggtgttctatcatggcttcacctcctccagcctggtttatagttattttgccgttgccctggcacaggcaggattccgggtagtcatgccggatgcgccggagcatggcgctcgcttcggcggcgactcacagggacggatacaccgattctggcagattctgcaccaaaacatgcaggaatttacgacgttacgtgcggcgattcaggcggaaaactggctacttgacgggcggttggcggtgggcggcgcatccatgggcggtatgacggcgctgggcattatgacgcgtcaccgtgaggtaaaatgcggggccagtttaatggggtcgggctattttaccgggcttgcccggacgcttttcccgccgttatccccgcagaacccggcacagcaggcggaattcgacaatatcatcgcgccgctacgtgaatgggaagtcacacatcagttagagcgactggccgacaggccgcttctgttgtggcatggtcaggaggatgacgtggtgcctgctatcgaaaccttccggctccagcaggcactcgccggggcgaagctggataagcatgtgacctgtttatgggccgcaggcgtgcggcatcgcattacgccagaagcgttgtcggcgacggtagcgtttttccgacagcatctttaaacgcggagtatgcttacaccctgggcttcaagctgttgcaaaacctgcggattggcatttttgccggtaatcagcatagcgatctgatcggctcggctgaacagcattcccgcgcgctcgccaattttactgctatcgaccagcgcgaccagtttcccgacgacgctgagcattttttgttccgccatggcggttagcatatcggtcttgtacaggccatccgcagttaagccctttccgctggtaaacatccagtggccagcatagagactgttttcacttccctgcgggctcagggtaatcgactggcttttgttgtactgaccccccatgataatcacgctgtcatgctcttgatcgatcagataattcgccagcggcagatagttggtaatgatctgtaccggcttcccgcacatttcgcgccccagcaggaaagcggtggagccgcagttaatcactacgctctcacccgggtttaccagctgcgacgccgctttcgcgatgcgtactttttcatcgtggttttgcgcctggtgcagattcatcggcgtccagcggggccgctgttgggtaatggcctctgcgccgttgcgcacttttttaagttttccgctttcgtcgagcttgttgatgtcgcggcgcgccgtcgccggggagattcccagacgctcaatcacgttttcgacggtaacaaagcccaactgtgccagcatatccagcagtatttgatgtctttgtgcttcagtcatgagctattccgatacaaattgatttgaaaagatgatatttgaaatagcctggaaatactaaagtaaatggaaaaaatgccgggtaatcccggcatgatatcgactcacaggaaggatttgaatggtagatcgggttcaatggtaaagcaatcgtcaaaaccacgcggatagtggtattcgaaattgtctttatccaacggccaggtaaacttgccgccaacctgccagataaacggtttaaaaccatacttcaggcgatctttcttcatttcccataacacgcggatctcctgtggatcggcctggaagttcgaccagatatcgtgatggaacgggatcaccactttggtgttcagcgactccgccatgcgtagaatatccgcgctggtcattttgtccgtaataccgcgcgggttttcgccataggaaccaagcgcgacatcaatttgatgttcgttgccgtgtttcgcgtaatagttggaatagtgagaatcgccgctgtgatagagattgccgcccggcgttttaaacagatagttaaccgcgcgtacatccatgccgtccggcagtacgccagcggctttctgatcggcgggcagggtgattaatgcggtgcggtcaaaggcatcaagcgcgtgaatttcaatatctttcacttttacgacatcgcccggttttaccacgatgcagcgttctttcggcacgccccagccaacccataaatccacgcaggtctgcgggccgataaacggaacatcatcggcgcaattctgcattacggcagccgcgacattgacgtcaatgtgatcgttatggtcgtgggtcgtcaggacggcgtcgatctgacggatagcgaaaggatcgagaacaaacggcgtggtgcgcaggttaggctgtaattttttgacgccagccatacgctgcatctggtgaccggttttcatcaacggattaccgtggctctgtttaccggtaccgcaccagaaatcgacgcatacgttagtgccgccttcagattttagccagatcccggtacagcccagccaccacatagcgaacgtacccggcgcgacctgctcttgttcaatctcttcgttcagccagcttccccactccggaaacgtgctcagaatccatgattcacgcgtgatgctttgtactttactcatcgcatttaccttcatgtttgttcaaaatggttcaaaacgtgatttgttttgattaatcctgacactattttctcaagaaggcaatgggctattttttgactttttggcaggagagaacgcagtcagaagaagatttaatcttgtctggcgtcatgtgaatgttggcatctttatgattttacttattttaatgaaaaaatgagttacctataagtaaaccatgtattaagtgtgctaattatttgcgcgctacgtcacatttaatcaaatttaatcttgttgtgattacttttgaaaattaaagtgaagggacattatcctgagcgcctgtgactcagcaaccttatctgccggagatcgttatggagatcctctacaacatctttaccattttctttaatcaggtaatgactaatgccccgctattactgggtattgtgacctgcctgggctatatcctgttgcgcaaaagcgtcagcgtgatcatcaaagggacgatcaaaaccatcattggcttcatgctgctacaggccgggtccggcattctgaccagcacctttaaaccggtggtggcgaaaatgtctgaggtctacggtatcaacggcgcgatttccgatacctatgcttcgatgatggcaacgatcgaacggatgggcgatgcgtatagttgggtaggctacgcggtgttgctcgcgctggcgctgaatatttgttacgtcttattgcgacgcattaccggtattcgcaccatcatgttgaccgggcacatcatgttccagcaggcggggctgattgcggtctctttctatatcttcggctattccatgtggaccaccattatctgcacggcgatactggtttccctgtactggggcatcacttccaacatgatgtataagcccacccaagaagtgacggacggctgcggtttctccattggtcaccagcagcagtttgcttcctggattgcctataaagtcgcgccgttcctgggcaaaaaagaggaaagcgttgaagacctcaaattgccgggctggctgaatatcttccacgacaacatcgtttctacggcgattgtaatgaccatcttctttggtgccattctgctctccttcggtatcgacaccgtgcaggcgatggcgggcaaagtgcactggacggtctacatcctgcaaaccggtttctcctttgcggtggcgatcttcatcatcactcagggcgtgcgcatgtttgtggcggaactctctgaagtgtttaacggtatctcccagcgcctgatcccaggtgcggttctggcgattgactgtgcggctatctatagcttcgcgccgaacgccgtagtctggggctttatgtggggcaccatcggtcagctgattgcggttggcatcctggttgcctgcggctcctcgatcctgattattcctggctttatcccgatgttcttctctaacgccactatcggcgtgttcgctaaccacttcggcggctggcgtgcggcgctgaaaatttgtctggtgatggggatgattgaaatctttggttgcgtctgggcggtgaaactcacggggatgagcgcctggatgggtatggcggactggtcgattctggcgccgccgatgatgcagggcttcttctccatcggtatcgcctttatggccgtcatcattgtaattgcactggcttatatgttcttcgctggccgcgcactgcgcgcagaagaagatgcagaaaaacaactggcagaacagtctgcttaataaggagttttgattatgaccgtacgtattctggctgtgtgtggcaacggacagggcagttccatgatcatgaaaatgaaagtggaccagttttaacccaatccaatatcgaccacacggtaaacagctgcgcggttggcgagtacaaaagcgagttgagcggcgcggatatcatcatcgcttccacacacattgcaggcgaaatcaccgtgacgggcaacaaatatgtggttggcgtgcgcaacatgctatcgcccgcagacttcggcccgaaattgctggaagtgatcaaagcgcattttccacaggacgtgaagtaaggacgcaacatgaaattacgtgattcgctggcggagaataattctatccgcttgcaggctgaagctaatacctggcaggaagccgtaaaaattggtgtggatttgctggtggcggcagacgttgtcgagccgcgttactaccaggcgattctcgatggcgtggaacagttcggcccttatttcgttatcgctccggggctggtaatgccgcacgggcgtccggaagagggcgtgaagaaaaccggtttctcactggtgacgctgaaaaagccgctggagttcaaccacgaagataacgacccggtcgatattctgatcactatggcggcggttgatgccaacactcaccaggaagtgggcatcatgcagatcgtcaacctgtttgaagacgaagccaattttgaccgtttacgcgcctgccgtaccgcgcaggaagtcctggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctgtgcgtgggcgaaggcgtgcgtgcggttcgcgatctgaaagcgctttacccgcacaaaatcgtgctggcagatgccaaaattgccgatgcgggcaaaatcctttctcgtatgtgcttcgaagccaacgcggactgggtgaccgtgatttgctgtgcggatatcaacaccgcgaaaggcgcgctggatgtggcaaaagagtttaacggcgacgtgcagattgaactgaccggttactggacctgggaacaggcgcagcagtggcgcgatgcgggcattcagcaagtggtttaccaccgcagctgcgacgcgcaggccgcaggcgtggcgtggggtgaagcggatattactgcgattaaacggctgtccgatatgggctttaaagtgaccgtgaccggcggactggcgctggaagacctgccgctgttcaaaggcattccgatccatgtctttattgctggccgcagcattcgcgatgctgaatcgccggtagaagccgcacggcagttcaaacgctccattgcccaactgtggggctaaggagcggctatgctgtcgaaacaaattccgctcggcatctatgaaaaagcgctccctgccggggagtgctggctggaacgcctgcggctggcgaaaacgctgggttttgacttcgttgaaatgtcggtggacgagaccgacgcccgactggcgcggctcgactggagtcgcgagcagcgcctggcgctggtgagcgcggttgctgaaaccggcgtgcgtgtgccgtccatgtgtctgagcgcgcatcgtcgttttccgctcggtagcgaagatgacgcggtacgggcgcaggggctggagattatgcgtaaagcgattcagtttgcgcaggacgtcgggattcgcgtcattcaactggcggggtacgacgtttactatcagcaggccaacgacgaaacgcgttgccgcttccgcgatgggttaaaagagagcgttgatatggccagccgcgcccaggtgacgctggcgatggagatcatggattacccattgatgaattccatcagtaaagcgctaggctatgctcactacctcaataacccgtgctttcagctctatccggatatcggcaatctgtctgcctgggataacgacgtacagatggagctacaggcgggaatcgggcatatcgtcgcggtacacgtcaaagatactaaacccggcgtgttcaaaaatgtgccgtttggcgaaggcgttgtcgatttcgaacgctgcttcgaaacgctcaaacagagtggctattgcgggccctatctgattgagatgtggagcgaaacagcagagaacccggcggcagaggtagcgaaagcgcgtgactgggtgaaagcgcgcatggccaaagcaggcatggtggaggcggcataatgcaaaagctcaagcagcaggtatttgacgctaacatggatttgccccgttatggactggtgacgtttacctggggcaacgtcagcgctatcgatcgcgaacgcgggctggtggtgattaagccaagcggtgtcgcctatgaaaccatgaaggtagatgacatggtggtggtggatatggatggcaaagtggtggagggtcgttatcgtccttcttccgataccgctacccatctggcgctgtatcaacgctatccgtcgcttggcggcgtcgttcatacccattcaacccacgccacggcatgggcgcaggcggggatggctattccagcgctcggtaccacgcacgcggactatttctttggcgatattccttgtaccagggcgttaagcgaagaagaagtgcagggcgagtacgagctgaacaccggcaaggtgatcatcgaaacgctgggcgaggtggaaccgctgcatacgccaggcattgtcgtgtatcaacacgggccgttcgcctgggggaaagatgcgcacgatgcggtacataacgcggtcgtcatggaagaagtggcgagaatggcgtggattgcgcgcggcattaaccctggcctcaaccccatcgacgattatctgatgaataaacacttcatgcgtaagcatggcccgaatgcgtattacgggcagaagtgaagtatgagctccggaatgtgaatattatcgggatgtcacaggtctaattccggagccatctttccgcgaaaaaagccccctgttcaggggggcaaatcaactatggctttttcgttggttttcctgatgttagcgataaatattcgcgctggcgtgtatgttgccgttgctacccggttcccggataagtatggcgtgataatacattgcgtttcgcgcgtcggcctcgtcattcagcgccagattggcttcgctttccgtggcgaagttatggttgatgtagatcacgcctaagctgcgcacatcatccatatttgtggcctggtgattatttaactcgatggctgccgttgccgttatgccaggcaaaagcgcagccagaaataacattatccgggctcgcatagagtacctcctcagcagcgcggtctggttggcgatatccccctttagtgaatcgcttctggtttaattttaaccataaccagccgcagagatggcgaccttttctgatgctgttgttcaaaaaattatcgcattgtcgttttttacctgattaacaacccgttgatgtatgccgctatgtttaagaaaccctgtgtggcaaaaaagtacgctgaccacagtgtcaatttttctgccgcaacaggccgtttatagtggcatgcgatatgaagttaatatctcagcagcaaaatgtgacgggacaggcgttacgttcggcacgataaataattgtacaatcaccttgagtttgcccgcaggcgccagtattataacgcgtcatttttcagccgacctttaacacgttccttgcctccatgggccgcggctgacccagacaggaggctgaataatccgtaaggagcaattcgatgcgtcattacgaaatcgtttttatggtccatcctgaccagagcgaacaggttccgggtatgatcgagcgttactctgctgccatcactggcgcagaaggcaagatccaccgtctggaagactggggccgccgtcagctggcttacccgatcaacaaactgcacaaagcgcactacgttctgatgaacgttgaagcgccgcaggaagtgatcgatgagctggaaactaccttccgcttcaacgatgccgttatccgcagcatggttatgcgtactaagcacgctgttaccgaagcatctccgatggttaaagcgaaagacgagcgccgtgagcgtcgcgatgatttcgctaacgaaaccgcagatgatgctgaagctggggattctgaagagtaatttctgatgaccaaccgtctgacgttgtccggcaccgtgtgcagggccccccttcgaaaggtcagtccatcaggaattccgcattgccagttcgtgcttgagcatcgttctgtgcaagaggaagccggctttcaccggcaggcgtggtgccaaatgcccgttattgttagcggacacgaaaaccaggccattactcacagtataacggtcggcagccgcataaccgttcaggggtttatttcttgccacaaggcaaagaacggtctgagcaaaatggttctgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtctctgctgccgtacactgatcgccatcagtaatcggtcacggtccattaatacgactttgagaggataaggtaatgcaagttattctgcttgataaagtagcaaacctgggtagcctgggtgatcaggttaacgttaaagcgggctatgctcgtaacttcctggtaccacagggtaaagctgttccggctaccaagaaaaacgttgaatacttcgaagcacgtcgcgctgaactggaagctaaactggctgacgttctggctgctgcaaatgcacgcgcagagaaaatcaacgccctggaaaccgttactatcgcgtctaaagcaggcgacgaaggtaaactgttcggttccatcggtactcgcgacatcgctgacgctgtgactgcagctggcgttgacgtggctaagagcgaagttcgtctgccgaacggcgttctgcgtaccactggcgaacacgaagtgaacttccaggttcacagcgaagtattcgcaaaagttatcatcaacgtggttgctgagtaatcagtcattctcgtttttgctagcaacgaaacgtcggcccagcgccggcgttttgcttttttaactccatcgcttttcgactggctatctccccctcttttcgcgataattaaaaataaaacattattttaatttcttggtgaaagaatggatacccaacgccaggcctccccgtttgcccgcaaaaacgtcgtttatgtgtgtgccgcattttgttgcctgctatggggcagcgcttatccagccatcaaaagcggttatgacctctttcagatagccaccgacgatatcccttctaaaattgtttttgctggttatcgttttttgtttgcgggtgggttgctactactgttcgcgctgcttcagcgtaaaccgattggtcggtttcgtccgcgccagtttgctcagttaacgttactaggtctgacccagacgtcgctgcaatatctctttttctatatcggccttgcgttcacctccggcgtgaaaggctcaatcatgaacgcgacaggcacattcttcagcgtattgctggcgcactttatttatcagaacgaccgattgagctacaacaaaacgctcggctgtattctgggctttgcgggcgtcatggtggtgaacgtcagcaacggcctggatttcagctttaatctgccgggagaaggctccgtggtgctggctgcgtttattctttctgcggccacattgtatggcaaacgtctctcgcagacggtcgatccgatggtcatgactggctatcaattggggattggcggtctggtactggtcattggcggttacgtttttggcggtacgctgacgatacatggcttctcgtcggtggcgattttagtctacctgacgctgctctcgtcggtcgcttttgcgctatggaacattttactcaaatataatcgcgtggggatgattgcgccgtttaactttctgatcccggtttctggcgcggctctttcggctatttttctcggcgagaatatattggagtggaaatacatgattgcgctggtgctggtgtgttcggggatttggtgggtgaataaggtgaagcggtaatgcttcacctgaacgaatagggtatagacggggtaaggcgcagccggcgttactgtgcgcgaataaaactgccgtcaggctgacgcgtaaacagcacctgttgaccgttatcgccatctatcgttaaacctgtcaccaccccgctggcattctggcgaattttaatcatttgaccatttttgaggttactcagcggcttgccagcgccttctacctgcgccattgcataaacgtctgtcgggggcagtccgtggtcacggaacagttgcgccagagttttaccaggctctacccggtacgagcgccattgttgaccgatgccgctatcctgctggaaaggctgcgtctgcggctggttttgttcttccggctggccttcctggataggttccgacgcaacgggcgccacctgatccggatcgttttgcggcgcgaccagttgcgcctgaagctgggcctccgtcggcggctgtgattgcgattgcagatccaattgcgcttcccgcgtgacgacaggcgagtcgctggtctcgctggcgggcagcaggaagccgatcaccagcacgatagcggcaatgataatgccacgacgatgcataggcggcagcggctccatgatgcgaaaattatccggcgcgtgccagattttcgccagggttggttttaattcaaagcgcccgggcatggtttacctcctgctccgcatctcgttccttaatcatagagtatagatggctaacgctatgatactggtagtgctatccgctttcgtgacatcaatacggataatctattgtttctttttccctgcgatttgtcatcctccctgagacaaagttttaccagaagaagcgtggctgttatgctgcccgctacttttttgatatccgatgaaggaaaaataatggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcaatggcggccgaaggcgtgaaatacctggaagaaaaccgcgaaaaagacggtgtgaacagtactgaatctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagcgctgactctgatgccggtaggttccaaatgggaactgactattccacaggagctggcctatggcgagcgtggggccggggcatctattccgccattcagcaccctggtgtttgaggtggaactgctggaaattctgtaagcgccccgggtttgccggatgatggcgtaaacgccttatccggcaaccctgacttcagcagatgccaatattttattttgcaaatggcgtcgttacgtgtatttttgtgagataattcgcattatcaaagtgatataacactcattttaaacataaaattaacattgtatttgaatcttagtattcatcccgccgattcttacctaatatcgatgagtcctgataacaggatcgtcgtatcatagaccaaaggccgtagagcccgcacaacacagacaggtacaggaagaaaaacatggtagatcaggtaaaagtcgcagccgacgaacaggctccggctgaacagtcgctacggcgcaatcttacaaaccgtcatatacagcttatcgctattggcggcgctattggtaccggtctgtttatgggatcgggtaaaacgatcagtctcgccggaccgtcgatcatttttgtgtatatgatcatcggttttatgctttttttcgtgatgcgcgccatgggggaattgctgctctcgaatctggaatataaatcgtttagcgattttgcttccgacctgcttggcccctgggcgggatatttcaccggctggacgtactggttttgctgggtagtgaccggtatggctgacgtggtggcgattaccgcctacgcgcagttctggtttcccggcctttccgattgggtcgcctcgctggcggtagtggtcctgctgctaagcctcaacctcgccaccgttaaaatgtttggtgaaatggaattttggtttgctatggtcaaaatcgtcgccatcgtggcgttgattgtggttgggttggtgatgattgcgatgcactttaaatcgccgaccggcgttgaagcgtctttcgcgcatctgtggaatgacggcggctggttcccgaaaggtattagcgggttctttgccggtttccagattgcggtgttcgccttcgtgggcattgagctggtcggtactaccgccgcagaaactaaagatccggaaaaatcgctgccgcgcgcgatcaactcaataccgatccgtatcatcatgttctacgtctttgcgctgattgtcattatgtcggtaacgccgtggagttcagtcgtaccggataagagcccgtttgttgagctgtttgtactggtgggtctgcctgccgccgcgagcgtgatcaactttgttgtgctgacctcggcggcgtcttccgccaacagcggcgtcttctcgaccagccgtatgctgtttggcctggcgcaagaaggcgtggcgccaaaagcgttcgctaagctatcgaaacgcgcggtaccggcgaaaggcctgaccttctcctgtatctgcctgctgggcggcgtggttatgctgatggtcaacccgagcgtgattggcgcattcaccatgatcactacggtttcggccatcctgtttatgtttgtctggaccatcattctgtgttcatacctggtgtaccgcaaaaagcgtccccacctgcatgaaaaatccatctataagatgccgctcggtaagctgatgtgctgggtctgcatggcgttctttgcgttcgtgctggtattgctgacgctggaagatgatacgcgccaggcgctgatcgtgacgccgctgtggtttatcgcgttgggtctgggctggctgttcctgcgtaagaacaaactggctaaatgacggatttatccctctcgcttaggcgagggggtatgcgcataacgtacccgccggggcgctttcttcatttttacgccccattttgtcgcttcccgctccttaacgagctatttttctcgccacatttgatagcgtatggagatgaaaagctcaggaaatgagtgtttgtccgctgatgcaatgacgcgaaaaacgtttcttcaggaagggcagctgtaaattgcaggctgacggtaagtgccgccttgatgaattcctataatggcggctcgcgctggataatacgttgaaaaagtggtttaagtaacaaattaatctcctatttcaaactgtaattatgaccattcgacgctggattttaagcgctacgcttttgctgctgcccgttcccgcgttcgcagattttcagtatcagcaggataaggacggcgttttttataccgccgacgacgaaccgcaaattctctcccgactgcctgacgttagctattcgcatttacggcgtattgccgatttatctcacccgcaagaccctcgcccgttaatagaaatcaatcccgacagccataactgcgacgacaatcatatttgtcagcacgcttatctcagcgatgggcactttatcctgtgggcaggcaaaatcgtccagaataccggggatgagcctgccgttgatgttgccagctttcagtcttttggcgcctttgccgccgataaacacggtctctattttgatggtaaacgtcgtgatagcaatgcgggtgaaaaacgtgtggatatggcaactctggcagagacgaaaatctggaatctgctgcgggataaaaataatctctattatgaaggccgctggctggggcgggccgatgggtttcgcgtgttgaggctggattccacttcggcaagggagtttattgtgacgacggcgcaacgggtgattgtgaacggcatacccattaccgctgatgctaatacgtttcaaatcattcgctggatgcctggcgaggtactaatttatcgtgataaaaccggtaagcatgactatgagattgataattccagtcggtactgcggctattttaatattggcctgcgtgaggtgacatggctgaagcatgaggcaaccaacgccgggagcagttgtaaagtggaaaccctgccgggtgtcgatccggagtatttttttcgtctgaatgggaacaccggttggtataaggatcgtatttatcaggtgagcacgaatgcgttgggcgagggggtgctgcgcatttttacgtcgcaggaaaaacttccggcgctgaaaatagatagagttacctataattactaccatctggctttgtccgcggatgggcaattatatcgccagatctcacgtgatcaatggcagagctataacccgatattaacagagtggacgacggtatcaccagcgcccactgacgttatctctttgcttccctctgattaccactagcgcaggatggcgcaatgttgagaataaaacagttctgtttatcgattttattaatgctggcaccagtgttagctctggcctgttccgacattccatatgctttgtttcactatcagccgtgggggcagggaacgaaatatgtagttgaagaagattatggttatagtattaattttaaagatattgaaattcgagaggtaaaatttagtcaactacggcacgttcctgaccgcattgttaatgaatataatgaccgtggaaaaatgagtaatgattttgttcatgtcgccgctttttcatcgctaataaaaaatgatttctggcagttttattggctaaccgacggccagcatattttatgggctgggaaaatcgtacaaaatccaccgggtaagccgccagtggatgcagcgacttttcgggcgtatggacgctttgccgctgataaagatagtctttacttcgacggcgagcgcacagatgataatcatggtgaaaaaagggtcgatatggattcgttgcagcaggtcggcggcaacatcaaattacgcgactccggcgatgtgcttaaagacaggcgcaacctctactttcagggacgctggctggctagtgcgcagggatattccatcctgggcgttaaatcctgggagcagcgtaatattctgttttcgccgaccagctgcgatactacatctaatcctggcccgtgggacactattctgcgtaccgccacgcaggtttttgttaatggtgtggcaattgatgccgatccgaactcttttcatgttgtgcgctgggtcgctggcgtgcagttactctatcgcgacaaagcaggcgtaaaacgctattacttcggcaaagactgtctcaatacgtttaatgtacagcgggataaggtgacatggatgacgcgagaggcatcgcgccgaggcgatgactgccgaatagcgactattcccaatgttgatccagaatatttccatcccattcattacaattggacggtagcacagtacaaagatctattgtaccaggtgaagtatgtctctccggtcgacagggtattaaccatcacccgcttgcctgatccgcaggtacagctgaaagctggcgctaatttggtgggtaaacagatctattttatcggcgatgggggagtgcagattatcgaccttattggaccattggtgtggtttaaaagtcccgatggttcattttctgatgtttttgctcatgacgatcgttatctctatttcttcggtgatacgctggtagatagcgggcaacggcgtaacgtaacgcggacgctggatactgcgcatatcgacaagagcggttattatctggtcactgaggaggggaaatatgaggttattaataatgcattcacctctcgctaaaaagcgttagtcgattcagaataaacgatcctgtctatgcgttcaggatcgtttattggcgatggattattccccggccagcgcgcgtgggaacagcacgttattctccaggctgatgtgctccatcagagcatcaatcatctcattaatgccgttatacatcgctttccaggtggtgcaggcttctggcggcggcgttacattttgggtgacgtgtttgatgacgtctaccagctctcccgcctcgtcatgctcgctttccattacgcttatcgggcccgttgcctggcgacccataccctgtttgatcatggggaacaggatctgttcttctttcatcatatggctggaaagctcttcatgcagcgcggtgagatattttgtcaggccgcgtgggacgtttggcttatccgcgtgaacgcgttccactttggttgcctgcaggataagctccggcagttgttcgcggtgtcggtcatgatagcgcacaacgatatggtcaataatgtccgtcagcggaacggcgcgccagtctttttcgatgggctgttcagccaactgcgcgagttgcgcttcaataatgtcaatatcgacgtcgtgacgagcggcggcgcgcgccagcgtctgttttccgccgcagcagtaatccatatcgtactggcgaaacagcgccgatgcgcggggaatagagagcgccagttcgcctaaaggttgatcgcgataagccatagccgttacctcatttgcaataatataagttgtattttaaatgcatctttaaggcgaggctataactctttcggggtgcgtataatttaagccaggatgagattagcgttccgtgaccggaacgacggtcgctttttccggtttcgctctcacggcaataaccacgcccgccaccaggagcgcaatgccgcttaacgtcaggaatggcgggatttcctggcgcagaatgaaggtatagagcagtcctgccaacgtttcaaaaacaatcagcggccctaaaatcacggttggcaatttttggctggcgatattccagcacaacgcgcccacccaggaacacagcaccgcgatggcgatcatcagaccgataaacagcgcgggatgcgggccaaagggcagggtaaacatcgggttctggatactcagccacagacaggttgccgcatagccgattaacgagaccggcagcgtaaccagcgcctgcgccgttgcccacatcatgggatgtttgtcgggatttttccgcagccagcgggcgttgcgcagcgcataccatgcccagcacgctacggaaatcagcgccagcacaatgcctgaaccatagcgccagccgctaacatcggacaatccctggctaagttcagcaatattgacgcacagcaggccaaaaccgataagcgccagcgcgggcgctaaacgtagccaggataatctgccgtctcgttggctatagagaacgttagcgaaaagcggaatgacgaccggcaatgtcccgatgatcatcgtcgaaaccggcgcgccggttcgctgaatggcgctggcgaggcaggcgtaatagattacattgcccatcagggtcagcgacagggcggtggaccagtctttgcgcgtcaactggcgtaaccgcgtgcggcctaaccaggcaatcggcagggcaatcagccccagcgccagatagcgtcccattgactgtaagagggccgggtaatccggcacgattaacgggccgacgaaaatcaatccccacattagccctgccagcagggcgtatagcacgccgctaatcatcagattctcctcataaaccgttccgtcattatcagagaaggtctatgaggatgccatataaattaactaaattttaacacttacagtacggagcgaaggctttctgtgagcgccgtcgtcgggcgaccgatgagtttacgcagcgtatggctgtcatcaaacagaccgcctttcgccgcgccagcgtcagaattggccaacatatccgccagtccgtcaggcaggcctgcgcctttcagcgcggcggcaaaatcgacttcgctcaggttctggtagacgattttttttccgctctgatgagtaagttcatccgccaactggcttaatgtccaggcgttatcacccgccagctcgtaaacattcccggcgtgaccctcttcacggatgacgcgcgcggcggcggcggcatagtcagcgcgcattgcggaggcgattttcccttctcccgccgcgccaataaagacgccatgcttcagcgcggcagggacgctcgccaggtagttttccgtataccagccgttacgtaatagcgtgtgaggaatacctgactcagccagcatcttttccgtttcaatatgttcatcggcgagcgccagcggcgatttatccgcatgtagcaggctggtataggcgatgaatttcaccttcgcggcaatgacggcctgaatgacgttgcggtgctgcgcggtgcgttgtcccacttcgctggatgaaatgagcagcagtttatcaacgccctgtaaggcggtggtcagcgcagcttcgttagcgtaatccgcctggcgaacggcaatcccgcgctgactgagcggggcggcttttttcgggttacggacgatcgcgacaaggtgactggcgggcgtcgtttttagcaggttttcaataacgtgttggcccagttggcctgttgcgccagtgatagcaatcatggtgaactcctcagtgttggtcttgtgttttattacgctaccacctaaacttacttttagtaagtacgtacaaaaaggtaagtatcaatgcgcgctcatactctttcccggcagttgcgtgaaggtaatctctttgctgaacagtgcccgtcccgtgaggtgttaaaacatgtcaccagtcgctggggcgtactgattctggtcgcgttacgcgacggtacacaccgttttagcgacctgcgccgcaagatgggaggcgtgagtgaaaagatgctggcgcagtcgttacaggcgcttgaacaggacggatttcttaaccgggtgtcatatccagttgttccgccgcatgtggagtacagcctgacgccgcttggcgagcaggtgagtgataaagtcgccgcgctggcggactggatagaactgaatttgccccaggtattggcgcagcgggagcgtttatcagatggcggctagcgctttattcggcctgccagtcaggccgaataaacgcagcgccatacgggactcacgttacttgctcaaatccacctgataaatggcaaaaccgatatcatcgacaccaacctttttcatcggatactgccctttctctttaatgaaggccgcggctttatcgcctggcgatgtttcaaagcggatatccagcgccgtatcgctgtggattggcgccagacgccagttattatccgccgccggatggatttcgcccgcgcgttttgactctgcgccaatccatgccgccagcacggcgcgattttcatccggagacgcaaaggcgatatggctgtcgcccgtgccggcaaacttgccgccgtaagcgcgatagttattcgtggcgaccaggaacgtagcgttcgggtcgacaggcttaccgttaaaggtcaggtttttaatacgttccgcctgcggattcaccatctggcattcgccatcatagcgggcgggctgtgacacatcgatttgataattcacaccgtcaatgacatcgaaattataggtgcgaaagccatcccaattgatcaacgattgcggtttgttgctgtgaatatcaatctgattaaactgtccggcagaacattccagccactcttttacctccttgccgctggctttcaccaccaccagcgtattcggatagagataaagatccgcggcgttacggaaggtcagctggcctttttccacctcgacaaagctggcaggatcgttcttacgcccgccaactttaaacggcgcggcggcggacagcaccggcagtttcgccagatccggatcgccctgaataaagtgttccacatacgctttttgcgcgttattcaccacctgtacggtaggatcgtcctgcaccagagcaagataactgtacatattatcggcggatttaccgatgggcttgctgacaaactcgcgggtggcatcgtgatcggctttcagaataccgaccagcttactgtcttccgccgccagcgactttttagcggcggcgtcgtaaataggccgcgcttccgctttcgcctgcgtaacctgccatttgccgctgtcgttattgagcaccagatcgaccactcccagatggtcgccccacatgcctggcattaccgcaggaatgccgttaagcgtacatttggcgatatccgcgcctttgatgtcggcaaaatctttaccggggaagacggcgtgggcgtgaccaaacataatcgcgtcgacgccgggaacttcgctgaggtaataaaccgagttttccgccatgctgtggtacggatcggcagaaaggcctgagtgagcaatgactaccacgatatcagcgcctttctcgcgcatttcgggcacatatttccgggcggtttccgtaatgtcattgacggtaactttgccgctcagattcgctttatcccaaatcatgatttgcggcggaacaaagccgatatagccgattttcagagtgtgcgggtggccgtctttatcaataacgctcgtctctttaatcagataaggcgtaaagagcggcttttgggttttaacgtcgataatattggcgttaacataagggaatttcgcgccggccagcgcgttatgcagatagtccagaccataattaaactcatggttgccgaggtttccaaccgcgtaatccagagtattgagcgctttatagaccgggtgaacatcaccgtctttgagcccttttgccgccatataatcgcccagagggctcccctgaatcaggtcgccgttatccaccagcacgctgtttttgacttcatttcgggcggcatgaatcaaacttgcggtacgtactaatccgaatttttcggttgcggtatccttgtaataatcgaaatccatcatgttgctatgtaaatcagtagtttccatgatacggagatcgacggtggccgcattcacgctggcggcgatcagcgtagccagaagcgttgcactaaacttaatcatcagaggcaccttttaagaacgcaatagaaaagccggatagtgaaaaatagcgatgataaacagtgaaaccggtatcgttccgaccgtcgccagaagaaggcgaaaccgccccatccggccgattttttgcgagtgttcacagaaaggtgaatcatgccatgaaagctattatcaaaaccgctgacggtatcacagttggcggaacccttaacgatcgggtataagtaaaacaacgagttaacgcccccgtcataaagaggtggagaatgttagaacaagtatgccagcttgcacggaacgcgggcgatgccattatgcaggtttatgatggagccaaaccgatggagtacgcccgcaagcaggacgattctccagtcactgcggcggatatcgccgcacataccgtgattctcgaagggttacgcacgctcacgccggatattccggtgctttcagaagaagatccgcccgcctgggaagtgcgccagcactggcagcgttactggctggtcgatccgctcgacggcaccaaagaattcatcaagcgcaatggagaattcacggtcaatatcgcgctgattgagcagggcaagccggtgttgggcgttgtctatgcgccggtgctgaaagtgatgtactacgcggcggaaggtaaggcctggaaagaggagtgcggggtgcgtaagcagattcaggtgcgggatgcccgcccgccgctggtggtgattagccgttcgcatacggatgatgaactcaccgaatatctccaacagcttggcgaacatcagactacctctattggttcctcgctgaaattctgtcttgtggcggaaggacaggcgcagctttaccccagatttgggccgaccagcgtctgggatactgccgcaggtcatgccattgccgttgcagccggggcgcacgttcacgactggcagggaaaaacgctggactatacccctcgtgaatcgttccttaaccccggcttccgggtgactatttactgaggagcttatgcagcaggtcgaccacctgctgtacctcttgctgggttaacgcgccatctttcacccattgaacccgaccgtctttgtcaagcacgatgacggcggacccctcttcttttaattgccaggcgttacgcgccacgccattgctgtcgacaataaattgcgaccacgggtagagctttttattactttctatactgctacgcacgaacataccggagcctgggattgcatcatcggtgttcacaattgtggtcgtctggtatctgtcatgcgggagcttggctgatttaatcgcttcaatcagcgtggcgtttttttccttcgctgacgttcgacccgcaatgtgcagcaggacgcgcacttttcccgccagctgcgcgctattccagtttttataactaaactcatctttattcaacgtcagttcgccacgatcggcaatgcctaccggcggcacccgttggttatcttcaaggttatgcgcacaagccattatggggagtagcagacacgacatcgccagaattttacgtagggtcatggtcattccttctttatttttttgcaggtgatccgaccactttgggccgacagttaatcatatgtgcgattgatgctttttcccgcaaaggggatgccagtttgcgggcgggtgcacacttcctgtgaaaaatgaaggcatatactgagaaaaatgagctgatgtttagataattctgaataactgtaatcaaaaggtaaatatacttatgcacactggaaacgacgtagatatggtctatagtcatatggcattaaaatttgcgccttaaaactgttgggccgattgtggcaccgcaagggcgtaatactctgcaggagacaacaatgaaaattttccaacgctacaacccgctacaggtggcgaagtacgtgaagatcctgttccgtggacggttatatatcaaggatgttggcgcttttgagttcgataagggtaagattcttatcccaaaagtgagagacaagcagcacttgtctgtgatgtctgaagttaaccgtcaggttatgcgtctgcaaactgagatggcgtaaccaaaagtgctatgcagtaggttaaaaaagtaaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacataattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaacaaaaaaacggctcctgaatcaggagccgttgatgtttctggcaaacggatttcaggccgcgctgtcttctttaccttgcgcatcgggcagtttcggcgccggtacgttgcttttattgtcgagacgcgtcaccagcaactgatcgatacggtagttgtcgatatccaccacttcaaatttgtagccggaaaacttcaccgaatcagtacgttttgggatcttgcgcagcataaacatcataaagccgccaatggtttcatagttgccggattgcggaaactcatcgatatccagcacgcgcatgacgtcgtcaatcggcgtgccgccgtcaaccagccaggaattttcatcgcgcgccacaatttgctcttccagtccctggccgaccaggtcacccattagcgtggtcatcacatcgttcagcgtaatgataccgacgaccagcgcgtattcattcataatgaccgcgaaatcttcgcccgccgttttgaaactttccagcgcctcagaaagggtcagcgtatccggcacaatcaaggtattgcgaatttgcacgccgctattcagcgccatactttggttcgccagcacgcggttcagcagatctttggaatctacatagccgatgatgtggtcgatatcttcattacacaccaaaaattttgagtgcggatgttcggctacctttttcttcaggctttgttcgtcttcgtgtagatcaaaccagatgatactttcgcgcgacgtcatagaagacggtacggtgcgggattcaagttcaaacacattttcaatcagttcgtgctcttgcttgcgcaagacgcccgccagcgcgccggcttccaccaccgcgtaaatatcatcagaagtaatgtcgtctttccgcaccattggaattttgaacaggcggaagatgttgtttgccatgccgttaaacagccacaccagcgggcgaaaaacgaacaggcagaagcgcatcgggttgatgatacgcaaagccacagcttctggcgcaatcataccgatgcgtttcggggttaaatccgcgaacaggataaacagccccgtcaccagcgagaaagagagaataaagctcaactgctcggagagttctggcgacatatagtgcgagaaaagggcggaaaaggcgggcgaaaatgccgcatcgccgacgataccgccaagaatagcgacggcgttcaggccaatttgcacaacggtgaaaaacatgccgggattttcctgcattttcaatacgcgttgtgcgttgatactgccttcatcagctaataacttaagtttaatcttacgtgatgcggcaagcgagatctcggagatggagaagaacgcacttacagcgatcaggcagaatataatgaatatactgtttaacatatcttatccggcgaaacgccagatcctcggaagggaagtttataaatccgtgtggtaacgtttaatgaaaaccggctcgtagcagtgagccgataagttcagggctagtatagcgtaagctactgtaaagtcgccagagggttcattttcaactccgacaagttccccctacgcctgcgtcgtcacgcgtcacgcgtcaggcggcaggcaaacgccgatcccgccaatcccgcagtaaccgtatggatttttgtgcagatactgttggtgttcatcctcggcgtagtaaaacggcgtcgcatgggcgatttccgtggtaatagggcgatggtctccggcggcggccattgccgactgaaagcgctcgcgactggcgtgagcggcggcattctgttccggcgttaagggataaatcgcagaacggtattgcgtaccgtgatcgttaccctgttgcatcccctgcgtcggatcgtgattttcccagaaggtctgtaaaagctgctcataacggataacggcaggatcgtacactatccgtaccgcttcggcatgaccggtctgcccggagcagacttcccggtaggttggattaggcgtgtaaccgcccgcataccctgctgcggtgctatatacgccgggcaattgccagaataaacgttctacgccccagaaacagcccatcgcgaagtaggcgatctccatcccggcagggacattggtcatagagtgttcatttaccgcatgcagagtggcgattggcatcggggtgttgcgtcctggtaacgcatctgcttgagtaaccagatgttttttatcaaataaactcatgaactattctcccgaaagcgttaattggcgttaaggttgtaacgagacgcatctttgcacacaataacaacattaatgtatctggatttaaccataagaaatatttgggcagtcgtctgcttttcaatcgaaattgttgattttatgttaagccgcggagcggtagtgtgattttttccaggggtgggaataggggatattcaggagaaaatgtgccacatatccgtcagttatgttgggttagcttactgtgcctgagcagttctgcggtagccgcaaatgttcgtctgaaagtcgaagggctatccggagagctggaaaaaaacgttcgcgcacagctctctacgattcagagcgatgaggtgacgccggatcggcgctttcgcgcccgagttgatgatgcgattcgcgaagggcttaaagcgttaggctattacgaacccactatcaaattcgacttgcttccaccgcctgcgaaaggacggcaggtattaatcgccagggttacgcccggccagccggtgttgattggcggtacagaagtcattttacgcggcggcgcgcgtacggacaaagattatctggccttactgaaaacgcgtccggcaatcggcacggtgctcaaccagggggactatgacaattttaaaaagtcgttaaccagcgtgtcgctacgcaaaggctatttcgacagcgaattcattaaaagtcagttgggaattgctctgggccgtcatcaggcgttttgggatattgattatgatagcggtgagcgctatcgcttcgggcctgtcaccttcgaaggttcgcagattcgtgatgaatatttacaaaatctgttgccgtttaaagagggtgatgagtacgaatcgaaagatttggcggaactaaaccgccggctttccgctaccggatggtttaattctgttgtggtggcgccggaatttgagaaatcgcgtaaaacaaaaattctgccgttaaaaggcgtggtatcaccgcgaaccgaaaacacgattgaaaccggggtggggtactccaccgacgtcgggccgcgcgtgaaagcgtcgtggaaaaaaccgtggatgaactcctacggtcatagcctgaccaccagcaccagtatttctgcgccggaacaggtgctggattttagttataaaatgccgctgctgaaaaacccgctggagcaatactatctggtacagggcggttttaaacgtaccgatttgaatgatacggagcaggactcgaccacgcttgccgtgtcgcgttactgggacctttccagcggttggcagcgggcgattaacctgcgctggagtttcgaccactttacccaggggaacgtcaccaataccaccatgctgttctacccgggcgtgatgatcagccgaacccgctcgcgagggggactgatgccaacctggggcgattcgcagcgctactcggtagactattcgaatacggcctggggctccgacgtggatttctccgtactgcaggcgcaaaacgtctggattcggactttgtacgatcgccaccgttttgtgatgcgcgccaatttgggctggatagaaaccggtgatttcgacaaagttccgccggatttacgtttcttcgccgggggcgaccgcagtattcgcggctataaatacaaatctatttcgcctaaagatagcgacggcaatcttaaaggtgcctcaaaactggcaaccggatcgctggagtaccagtataacgtcaccggcaaatggtggggggcggtgtttgtcgatagcggcgaggcggttagtgatattcgccgtagcgatttcaaaaccgggaccggggtcggcgtgcgctgggcgtcgccggttgggcctgtcaaactcgattttgccgtaccggtcggcgacaaagacgaacacggtttacagttttatatcggtctggggcctgaattatgagtttatggaagaaaataagcctcggcgtgttgattttcattgtggtgttactggcgagcgttgcgtttctggtcgggacgacgacggggctgcatctggtattcggtgcggcgaaccgctgggtgccggggctggatattgggcaggtcaccggcggctggcgggacttatcgttaaaaaatatccgctatgagcagccgggcgttgcggtaaatgcgggcgaaattcatctggccgtcgggcttgattgcctgtggcgcagtagcctgtgcgtcaatgatctggcgctaaaagacattaatgtcgctatcgacagcaaaaaaatgcctccttccgaaccggcgcaagaagaggaagaaagcgggccgctgaacctctccacgccctggcccatcacgctgtcgcgcgtggcgctgaataacatcaatatcaagattgatgacactaccgtttcggtgctggattttacctacgggctggcatggcaggagaaaaacctgaccctgaaaccgacgcggcttcagggactgctgatcgcgctgccgaaggtcgctgaggtggcgcaggaagaggtggttgaacccaaaatcgagaaacctcaaccggatgaaaagccgcttggcgaaacgctaaaagatctgtttgcaaaaccggtaatgccggagatgaccgatgttcacctgccgctcaatctgaatatcgagtcatttcgcggcgagcagctacgcatcaccggcgataccgatctgacggtgcgcacgatgctgcttaaagtcagcagtatcgacggtaatatgaagctggatactctggatatcgacgccaaccagggcacggtgaaagcctccggtacggcgcagctcgccaataactggccggttgatattacgctcaacagtacgctgaatatcgatccgctaaagggtgaaaagatcaaactcaaggtcggcggcgcgttacgcgaacaactggaggtcagggtgaacctttccgggccgatggatgtcgcgcttcgcgcccagacgcggctggcggaggccggtttaccgctcaatcttgaggtcgtcagccaacgcattgcctggccattgacgggtgatacccagtttcaggctgacgatctgaagctcaaactgagcggtaagatgaccgactatacgttgtcgatgcgaaccgccgtgaaaggacaagatattccgccggcgaccatcacgctggatgctaaagggaatgagcggcagattaatctcgataaactcaccgtcgccgctctggagggaaaaaccgaactgaaagcgctggtggactggcagcaggcgattagctggcgtggcgaactgacgctgaatggcatcaataccgctaaagagatcccggactggcccgcgaaacttaacggcgtcatgaaaaccaaaggcagcctctacggcggcacctggcagatggatgtcccggagctcaagctgaccggtaatgtgaagcagaacagcgttaacgtcaacgggacgctaaagggcaacagctacatgcagtggacgatcccggggctgcaccttgcgctgggcccaaacagcgccgatataaaaggcgagcttggcgttaaggagctgaatcttgacgccgccatcgatgcgccagggctggataatgcgctgccagggctgggcggcatggcaaaaggaatcgttaaagtccgcggtacggtagaagcgccgcagctgttggcggatatcaccgcccacggtctgcgctggcaggagctgtctatcgcccaggcgcgcatcgagggcgatattaaatccaccgatcagatagcgggccatctcaacgttcgcgtagagcggatttcgcagcccgacgttaacatcaatctggtgacgcttgacgccaaaggcagcgagaagcagcatcagctacagctccgtgttcagggagaaccggtatccggtcaactctccctgacaggcagttttgatcgcgaggaggcgcgctggaaagggacgttaagcgacacccgtttccagacgccagtggggccatggtcgttgacccgcgcgattgcgctggactaccgtaataaagaacaggaaatcagtatcgggccacattgttggctgaacccgaacgccgagctgtgcatcccgcaaaccattgatgcgggcgccgcaggacgggcgttggtcaatctcaaccgctttgatctggcgatgctgaagccatttatgcctgataccactcaggccagcggggtctttagcgggaaagcggacgtgtcgtgggacaccacccaggagggattgccgcaggggaaggtcacactttccggtcgtaacgtgaaggtcacgcagaccgtcaatgacgcgccgttaccggtcgcgtttgagacgctgaacctcagcgccgatctgcacaataatcgcgccgagctgggatggctgattcgcctgacgaacaatggtcaattcgatggccaggtgcaggtaaccgatcctcaggggcggcgcaatctcggcggtaacgtcaacatgcgcaatctcaatctggcgatggtcaaccctgtctttttgcgcggcgaaaaagcggcgggaatgttaaacgccaggctacgtctgggcggcgatgtgcaaagcccgcagttgtttggtcagttgcagcttagcgcgctggatattgacggtaattttatgccgtttgagatgcagccgagccagctcgccatgaactttagcggtacgcgctcgacgctcgctggtatcgtgcgaacacaacaagggcaaattaacctgaacggtaacgccgactggagccagattgacaactggcgcgcgcgggtgacggcgaaaggcagtcgggtgcggattaccgttccgccgatggtgcgcctggatgtctcgccggatgtggtctttgacgcgacgccttcgctgttcacgttggatgggcgtgtggacgttccgtgggcacgaattgtggtgcacgacctgccggagagcgcggtcggcgtctccagcgatgtggttatgctcaataatgacctgcaaccagaaacgccgcagacagcatctattcccatcaacagtaatctgacggtacatgtcggcaacaacgtgcgcatcgacgccttcgggcttaaagcgcgtttgaccggcgatttgaaagtcgcgcaggataagcaggggctggggctaaatggtcaaatcaatattcctgacggccgattccgcgcctacggccaggacctgcttgttcgtaaaggcgagctgctgttctccggcccgccggatcagccgctgctcaatatcgaagcgatccgtaaccctgacgtcaccgaagacgatgtcattgcgggcgtgcgcgtcacaggcacagctgatgaacccaaagcggaaatcttctccgatccggcgatgccgcaggctgaagcgctttcttatctgctgcgtgggcaggggttggacagcaatcagagtgatagcgcagcaatgacttccatgcttattggcctgggggttgcgcaaagtggtcaggttgtgggtaaaatcggagagacattcggtgtaagtaatctggcgctggacacgcaaggggtgggcgattcgtcccaggttgtggtcagcggctatgtactgccgggtctacaggtgaagtatggtgtagggatatttgactctctggcgacgctcacgttacgttatcgcctgatgcctaagctatatctggaagcagtgtctggcgtagatcaggcacttgatttgctctatcagtttgagttttagcaatgcgaatatttgtctatggcagtttacgacagaaacaaggcaacagtcactggatgaccaatgcccaattgcttggcgattaccgtatcgataactaccagttgtatagtctgggccactatccaggcgcagttccgggaaacggagcggtatacggtgaagtttatcgaattgataacgccacgctggccgaacttgatgctttgcgcaccaggggcggtgaatacgcacgccagttaatccagacgccttacggcagcgcatggatgtatgtatatcaacgtcctgttgatgggttaactctgattgaaagcggtgactggttagacagaaaccagccctgaactgaacacgccaccctcgggtggcgttgttttttacattctggctgatggcgttaacgccgggcatggtgagctcttattctgccgtagatcaataatgacgcgccgcccaggataacaatgcatccgagaaccataaatccctgcatatagctgccggttgtccggtaaaaatagccgaccattaggcctgccaacgtaccgccgccgccggcgccgatgccattaataataccggaggctgggccaatcgcatggggtttaacgttcgactggataatcgaccagatattgggggtaaagctggcggcataataacccatcgccagggtaatgagcgtgattttaaagcccggcgcatcgacaaatggcaggagaaataacatcacgccggggattagtaggcccagtgaagcaataagtacacgtttttgtgtcttatcactgatccatgagatggggattgccagtataaccgcagtcagataaggcagagaactgaccaatgctttactgaatccggtatagccgagagaattgacaaccatggggatccataacgtaattccccagaacaacatcccttgagtgatgtaggtaaaaataaggagtaggaagggggttccgcccagcgattccagagtaagtttagttttctctgttggcgccggcgcacgataataaggcgcttcttcctgttttttcagcattgttatataaagtggaaccacaacaacaatgccgatcataccagtgataataaaaacatttcgccaaccgaaggcagcatccagcggggacaaaatcataaatcccaggcctaatgccaggaactgtccataatactggataatgctgttcgcctgcgtccgttctttgtctgaaaaccagtcgctggcgaagcgggactgctgcggccaataaatgccttcggtaatgccaagcaccagccgacaaatcaaaataacgtacactgacgaggtaaatccgacaaaaacggtcgcaatcgaccagattagcaccatcagaatgactatttttttcggatcgtatcgctgggtaaatacgccgccaaaaatatttgaaaaggcatagccaataagaaatatggttaatacaatgctggccgttgcgccatcaatattcaggtcgtgtgtaatcgtaggtaacgtaacggaaagattagaacggtcaagataagcaacaaaaaggccgaacattaatgtcgcgccgatccgtagccatttttgcattgaggtcatttttcaactccgtttggccgcgtgccaaaatcaatttgacgaaataatatctcaccggattttatggtcatttgtggtaccagcacatgcgtccccgtgagcgtttcaccatgaatatcggcaaattcaacatgcctgttttttaatttaaagatggcgatatcggcaaatgccccaggggccagcgtaccaatttctgctgccatacccattaaaactgctggggtatgggtacaggcgttaatgacatcggcaagcgtgacgccgagtgctaaatatttcgataaaatccatggtaaggcgtaaacaggccaggcgagtttagtgatggttgagagatcgctactgatgatatccggaagaaagccattggcgatggcccggcgtgccgtgttcattgaaaaatggctgcgaccattggcggcatcaaatataacgcctcgttctcttgcatgacggacttcggctaagaccgcgccttcattagtaagaatggtgctacctttgccgtgaaacgcatgagcgataatatcgccgcggcgtagcaaggagacaagttctttcatgggaacgacgggatgagtcgagtgtattgctacggggcaccttaaatcgttggcaatacgaagggattcagtcagcggttttaagccatattcagcaatgtcctcagtctgaaccttgagttttaatccctgaagaacgttgcgatactggcgaaacagcgcgtggatcttattttcatcaatattgtcaggatcataattttcttgtgaccagatttggcccggcggcgacacggtcagaaacgctttgattcgaactttgctggcgcaaatcaccgttcggtagaaggcatcaaagtttgccgtaccggcagaacctgcatccacgacggtggtgacgccattcggcggcatgtacatatcaggcctgacgccgccttccgtcgcatcataaaaaacatgcgtgtgataatcgataagaccgggagtgacgatcatgccgtcggcatggataatccgggtctccgaagttacaggatatttatcggcatcaacgataatatcgttaatgatgcgtaacttgttaatctcattaatattacgagcgggatcgatgatatgtccaccggtaattaatatatcatttttcatcataatctcttaaaatagtaaataattatggcagcccttgaaaatatattaaaaagtgtgttttgagcggatgttatgttggattgaaaatacagttattggtagggagagcttaggataccttattaaaaaggtaatcgggcttatgcactaaataagaatttagcgcttgctaatatttagggcgtaagtccatgggagtctgggggcattcgcaaaacaattattatcttaagctttttagagaaaacgtgagcgtattcaaccctttttaataaaaaataaggtaaagtcttattcattctgtgaatgttaaactaataatgataaaaattgtgttctattcattagccaataaaaaggccctcattactatgagagcctttatcttgacgattatgtaaaagcgaacttatttcttcgctgcgcgctcgaaagaggcaacgatttccgctttagccgcttcggcgttgtcccaaccgtcaactttcacccatttgcctttttcgagatctttataatgctcgaagaaatgagtgatctgcgctttcagcagttccggcagatcgttcacatctttaatgtgatcgtactctttgctcagtttggtgtgcggtacggcaaccagtttcgcatcttcaccggattcgtcggtcattttcagtacgccaaccggacggcaacggatgacggcgcctggctgcagcgggtacggcgtcgggaccagaacgtctaccgggtcgccgtccagagacagggtatggttgatgtaaccgtagttgcacggatagaacatcgcggtggacatgaagcggtcaacgaacagcgcgccgctctctttgtcaacttcgtatttgatcggatctgcgttagccgggatctcgataacgacgtagatatcttccggcagttctttacccgccgggacgttgagtaagctcatgtctgtttcctttgaagttatgacaaacaagtggcgagtattatagccaactcacgccgaaagtcttcgcttgttttcgtttccgcctcatctggcgcgtcgttgcggagcataaacgacaaaggttaagaaccgaaaaaatcacgggcctgataaggcaacgccgccatcggacatcttattgcccaatggcggcttcatgcgttattccgcatggtggtaaagattacgcgtccgggtattcgcggataaagcgttccacatcgtcaaccatatggcggttgccgacgaagaacgagcggcgctggtgcaggctttccggaatgatatccagaatacgttctttaccatcgcttgctttgccaccggcctgttccgcgaggaacgccatcgggttgcattcatacagcagacgcagtttcccctgcggatggctggcggtgctggggtagagatagatgccgcctttcagcaggttgcggtggaaatcggccaccagagagccaatgtaacgtgaggtataagggcgacttgttgaactatcctcttcctggcagaatttgatgtacttcttcacgccattcgggaacttaatgtagttgccttcgttaatggagtaggttttacccttttccgggaaacgcatacgttcttggcacagacagaacacgcccaacgacggatcgtaggtgaaagcgtgtacgccgcagccggtggtgtaaatcagcatggtggacgagccatacacgacatatcccgcagcgacctgtttgttgccgggttgcaggaaatcttcttcggtgaccggcgtgccgacgggcgtcacgcggcgataaatcgagaaaatcgtaccgacagagacgttaacgtcgatgttagaagagccatccagagggtccatcagcaccacatatttcgcgtgttcgcagccttcaaagacgacaatttcgtcctcttcttccgatgcgatgcccgctacaatatcgcgcgcttttagtgcagctttcagtttctcgttcgcgaacagatcgagtttctgctgaacctcgccctgtacgttctcagcacagctggcacccaggatatcgaccagaccggccttgttgatatcgcggtggatgatcttggcgcccaattttattgccgacagcaaagcagtgagctcaccggtagcctgagagaactcgtgctgcttttcgacaataaattcacctaacgttttcataacactttccctgcaattgattggagtaaagcgaccgtaacaatcttaacaaacatttcagatgatgcgctcaggtgaatcgcgccagcaaagtacagatttacctgaaatgcgtttctcacttgccagacatgtgcgtaaaatggctcgcagataaaaaaaggatagtgacgtatgcgcattcatattttgggaatttgtggcactttcatgggggggctggcgatgctggctcgctcgcttggtcatgaagtaacgggttcggacgccaatgtgtatccgccgatgagtaccttacttgagaagcaaggcattgatctgatccagggttatgacgccagccagctcgatccgcagccagatctggtgattatcggcaatgcgatgacgcgcgggaatccgtgcgtggaagcggtgctggaaaaaaacattccctttatgtctggtccacagtggctgcatgactttgtgttgcgcgaccgctgggtactggcggtcgccggtacccacggtaaaaccacgaccgcaggcatggcgacctggatactggaagcgtgcgggtacaaaccgggcttcgtgatcggcggcgtaccgggcaattttgaggtttccgcacgcctgggcgagagcccattctttgttatcgaagcggatgagtacgactgcgcgttctttgataaacgttctaaatttgtgcattactgcccgcggacgctgatcctcaacaaccttgagtttgatcatgccgacatcttcgacgatctgaaagcgatccagaagcagttccaccacctggtgcgcatcgtgccggggcaggggcgcatcatctggccggaaaacgacatcaacctgaaacagaccatggcgctgggctgctggagcgagcaggagctggtgggcgagcagggacactggcaggcgaagaagctgactacggatacttccgagtgggaagtgtggctggacggcgaaaaagtcggcgatgtgaaatggggcctggtcggcgaacataacatgcacaacggtctgatggcgattgccgccgcgcgccacgtgggcgtcgcgcccgcagaagcagccagcgcgctggggtcatttattaacgctcgccgccgtctggagctacgcggtgaagcgaacggcgtgacggtgtatgacgattttgctcaccatcctacggcaattctggccacgctggcggcgctgcgcggtaaagtgggcggcaccgcgcgcattatcgcggtactggagccgcgttctaacacgatgaagatggggttatgcaaggatgacctggcgccgtcgttagggcgtgcggatgaagtgttcctgctgcagccgccgcatattccgtggcaggtttcagaagtggcggacgcctgcgtacagcctgctcactggagtggagatgtcgatacgctggcggatatggtggtgaaaaccgcacagcctggcgatcacatcctggtgatgagcaacggcggtttcggcggcatccatcagaaattgctggatgggctggcgaaaaaagcactggttgtggggtaaaaaatgcccggtggcgctgcgcttaccgggcctacaatacgtacattcccgtaggccggataaggcgttagcgccgccatccggcagacgctatcaacatgtaaaattacccttcgttttccgccagctcgcgcagatactggaagatctgacgcgctgatttcggcggtttgttgccttctttctctttcttcgcattgcggatcaatgaacgaagctgttgacgatcggcgtgcggccacagggtcagtacttcggctaccgcgtcattgccttcgacgatcagacgatcgcgcagatgctcaagcttgtgaaacagcaccacctgctgattatggcggttcttcagcttgtccagcgcctggcgaataggttcaacgtcgcgttggcgcagcatttttccgataagctgcaactggcggcggcgtccttccattttgattcgctgggccagttcaatggcgtcgcgcagatcggcgtccagcgggatcttatccagcgcgtttttccccagatccaccagttccgcgcccaggcgttttaattcctcggcatcgcgtttaatttcacttttactgacccagataatttcatcgtcttcgtcttcgatgtcatcaccgggaacgtcgtcgagccagtcttcgggctgctttgtcatgtcaggctccttaaaaaaagaggctaatgttaccagttaagatgcgcactgaaaaacggttctctgttagacttcagagaaactctctctacattatggcatttgcaatgaaagtaatctcacaagttgaagcgcagcgtaagattctggaagaagcagtttcgacagcgctggagttagcctcaggcaaatcggatggggcggaagtcgccgtcagcaagactaccggcattagcgtcagcacccgttatggtgaagtagagaatgtcgaatttaatagcgacggcgcgctgggaattacggtgtatcaccagaaccgcaaaggcagcgcctcttcgacggatttaagcccgcaggcgattgcccgtaccgtgcaggccgcgctggatatcgcgcgttacacgtcgccggacccgtgcgcaggcgtggcggacaaagaactgctggcgtttgacgcgccggatctggatttgttccacccggcagaggttacgccagacgaagccattgaactggccgcgcgtgcggaacaggcttctctaaaggcggataaacgcatcaccaataccgaaggcggtagctttaacagccattacggcattaaagtgttcggcaacagccacggtatgttgcagggatattgctccacgcgccattcgctctcaagctgcgtcatcgccgaagagaacggcgatatggagcgtgattacgcttacaccatcggccgggcaatggcggatctgcaagcgccggaatgggtcggggccgagtgcgcgcgccgtaccttatcccgcctgtcgccgcgcaagctctccaccatgaaagcgccggtcattttcgccaatgaagtggcgacagggctatttggtcatctggtcggggcgattgccggcggcgcggtataccgtaaatccacttttctgctcgactcgctgggcaaacaaattctgccggaatggttaaccatcgaagaacacccgcatctgctaaaagggctggcgtcttcaccgttcgacagcgaaggcgtgcgtacggagcgccgggacattgtgaaggatggcgtactgacgcaatggttgctgaccaactattccgcccgcaaactggggctgaaaagtaccggtcatgctggcggcattcataactggcgtatcgccgggcaggggctgaactttgagcagttactgaaagagatgggtaccggcctggtggtgacggaactgatgggccagggcgtcagcggtattaccggcgactactcccgcggcgctgcgggattctgggttgaaaatggtgaaatccagtacccggtaagtgaaattaccattgccggtaatttaaaagagatgtggcgtaatattgtcaccgtaggcgatgatattgaaacgcgcagtaatatacaatgtggttcggtattgttaccggagatgaaaatcgccggacaataatacccgtcatacttcaggctgcaggcgcgttggctgcctgcaactcgaattattcagggtattacacttatcgttaataataaaaaggaagtgagcaatgcgtaaaagcctgttagctattcttgctgtgtcatcgctggtattcggttcggctgtttttgctgccgatcttgaagataatatggatattctcaatgataacctgaaagttgttgagaaaacggatagtgcccctgagctgaaagcggcattaactaaaatgcgcgcggccgcgctggatgctcaaaaagctacgccgccaaagctggaagataaagcgccggatagcccggaaatgaaggattttcgtcacggttttgacattctggtcggccaaattgatggcgcgctgaagctggcgaacgaaggtaacgttaaagaagcgaaagcggcggcggaagcgctaaaaaccacccgcaatacgtatcataagaagtatcgttaatttttgtgggatggcggcttcgctttatccgcaggtcgccatccggcaaaatgtaatacccatcacactttctcactttatacgacaacgtcattgtttcgccatttcctctttatgccgcgatagatctcacactttcccggcgataattcatcaatgccgctttttctgtggcgcagatcacctatcccactcgcgtttccacttcgaggtggaaaataactcgctacaaacttttaacccttaccgctagttttatctcattgccattaatggggtgagacgcgtggataacggagcagtaaaacacgatgccggtgagcgaattaacgaactggctgaacaggtgttaacgcaggtggatggcctgctggggcgacatcacattgtccccaatgcggtacagacgcaaatgctgacctcgcacgttcgcgcgatggcgcaccggtcaattaccggcgagcctttaccggaagtcgatgccagcttgtttgatgaaatctcagccgaatcaatggcgctcgcccgcgaaatcgtggcggcgtttggcaaccttcctgacgaagaagcctggctattatcggtacattttgaagtcgcgaaagacaacctctaaggagcaaaaaatggaacagattaccgtcgtaattggcgatcgcctgggtaaaggccagaaagtggcggcaggcgtggaaaaagcgggcggtcgcgcggtcgtcgtaccgggcgtcgcggcagacatgaagctgggcgatgtgatgaaagcggaaaacgccaccttcggcatttcattttgcggcagcggcggcgcgggcgctatcaccgcgcaaaacaagcatggctacaaagccaaatatgggatgcggtcagtagatgaaggagtcaccgctatcaatgagggctgcaacgtgttgggtttcggctttatggataaagaagagctcggcgagcgcctggtgcaggcgtggcaaaagaaatacggcgcctgatgatgaaagagcaattcaccatcacggtgagagtaaaaggcaagggcgacgccaaagcacgcgcctttgccgatgcgctgaaccatgttcagtcggcggtgatgagagagtcgccgtatatcttactgcgtattgagccacaggatgtgcggattgttcaggcgcatgagtcggtgcgtaaagaggcctttctgtttttctttttgcgccgggaacgacgcacttacagcgtggagctggatgtggccgtcaacgtgaccgccatcaatctcgacagggtggatttcgtcgcgaaacgctgatttttattaaaaaggcatagttatgttcctgataatactaattaaatctctcattatcggcgcgctggtcggcgtaggggtgggcgctggggctgcacgtatgtttcacgcgtcaaccacgcaggggatgggcgcgttccgtacgttgggcgaactcaactcttgtgaaggcgacccggcatctcacttctcctttggactgggtttcttctttaacgcctgggcgtcgtctgtggcggccggatcgttcacccaggatgtcgatcaccgcatcatccctaactggggcgcggcggcgctaatgatcaaaaaccgtaacgtcggcgagacgctgcacgacccgaaaaaaatggcgatcgcctgcgccgtcatcggcatgatcgtcgtgacgttccttaacctgaccgcctcatccgtgccagaagcgctacaggtgacggcggttaaggtgctggtaccggcggcaaacctgctggtcaacatcgtcatgcctgtgattttctggttagcggcgatcgacgctggtaaaaaatcgggtttctgggccaccgttttcggcggcgcggcgcagctcatcatggggaacgccgtaccggggctggtgctgggtattttgatcggcaaaggcgtagaagagagcggctggaaccatgtcaccaaagtgatgatggttgccatcgttttgctgtttgtgttgagcggtttcttccgcggcttcgacatgaaaatgatcgagtctttcaacatgacggtaccgaactggcttgaactgatccacaactcgctcagcggcaaataacggagaccacaatggaagagaataaaggtttttggtatgccgactggtcgttcccgatctttgttggcctgctctcctccggcgttttcgccgggacgcatatgtactatctgtacggtatcggcgcatttaacgaagtcgcttttgtggcgatgttgaaagcggggatggataccggcgtctacggcgcggtcgccgctttcggcgccagctttttatttgcccgcattatcgaaggttcgctggtcgggattctggatatcggcggggcaattcagactggcgtgggcttaggggttccggcgttactgctgggggctggctttgtcttcccggtggcgaactttatcgcttcgctgataaccggtctggtgattggcctggcgattggctacatcattattctggcgcgtaagttcactattaatcagagcgactccacgtacggggcggacgtcatgatgggggccggtaacacttcaggccgttttctggggccgttgattatcctcagcgccatgacggcatcgattcctattggtctgggctctctggtgggcgcgctgctgttttatatctggcagaagccgattaccggcggcgcgattttaggcgcgatgatcctcggttccatcttcccggtttcgattagctaactgttgatttgtaggtcggataaggcggttgcgccgccatccggcaaaggagagaacgatgtttgatttactcctgcgccatgcgcgtctggtcgatgacacgctgactaatattgcccttcaggatggcaaaatcgcggcgttgggtgacgttgatggtccggcgctgaaaaccattgacctgcgcggcgaatgttacgttagcgcgggttggattgattctcacgttcactgctacccgaaatcgccgatttaccacgacgaaccggacagcgtgggtattgccactggcgttaccacagtggtggatgcaggcagcacaggcgctgatgatattgacgatttttacacgctgactcgtgacgcggccaccgaggtttatgcgctgctgaatgtttcacgcgttgggcttattgcccaaaacgagctggctaacatggccaatattgacgctgatgcggttcggcaggcggtaaaacgccatccggattttatcgtcggcctcaaggcgcggatgagcagcagcgtggtaggcgttaacggcatcacgccgctggaacgcgctaaagccatgcagcaagaaaacggcaacctgccgctgatggtacatattggcaataacccgccggatctggacgaaatagcggagcgtctgacggcgggcgatatcattacccactgttacaacggtaagccgaaccgtattcttcggcctgacggcgagttgcgcgcctcggtgacacgagcgctggcgcgcggcgtgcgtctggacgtcgggcatggtaccgccagcctgagctttgcggtggctaaacgcgctattagcctggggattttaccgcataccatcagttccgatatctactgccgtaaccgcatcaacggcccggtacattcgctggctaatgtgatgtcgaaattcctcgccatcggcatgtcgctgccgcaggtcattgcgtgcgtgacggccaatgccgccgatagcctgaatctgaaaaccaaaggacgtcttcagccaggtctggatgccgacctgaccctctttacgcttaaacgccagcccaccgtgttggtagacgcggaaaacgacagcttacaggctgaagaattgctgacgccgcttgccgcgatacgcgcaggcaagggctatatgaccgaacaagggagcgcggaacatgccttcgatttttgagaagtatcaattaaaacaggtgattaacgcctccggacgtatgacggcgctcggcgtctccacaccgcgcccggaagtgatagacgcggcgatggccggaatgaatcagtatttcgagatgaaagatctggtgaataaaaccggtgagtacattgcgaaattgctggaagtggaaggggcgacggtagtctcctgcgccagtgcgggccttgcccagtcggttgccgcggtactggttcaggacagcgactggctgctggaaaacctgcacgttacaccgattgaaaataacgaaatcgtcctgccaaagggccacaacgtcaactttggcgcgccggtgggaacgatggtggcgctgggcggcggcaaactggtggaagccggttacgccaacgaatgttccgccgcccagttggcggcggccattacgccgcgcacggcggctattctctatatcaaatctcaccactgcgtacagaaaagtatgctcagcgtggagcaggctgcggtggtggcgcgcacgcataatctgccgctgattgtggacacggcggcggaagaagatttgcagtgctactaccgcgtgggcgcagatctcgttatctatagcggcgcaaaagcgattgaagggccgaccagcgggctggtgattggcaaaacacagtatgttgagtgggtaaaacgtcagtcagcgggcattggccgggcgatgaaggtcggcaaagagggaattgttggcctgacctgcgccattgaattgtacctgcgggcgcaaaaagagagcggcgcggagatggtagaaaaaatggcgccctttatcgacacgttgaacacgtttaacggcgtcagcgcccgcgtggtgtgggacagcgccggacgcgatatcgcgcgcacggaaattaagtttgatgaagccgttaccggcatcgccacaggcgacctggtcgacgcgctgaagcaaggggaatacgcgatttactttcgcggatacaaagccaacgaagggattattgaagcggatgtccgcagcgtcgatcgcgcgcagttagcgattgtggcgcgtcgtattggcgaggtgattaatcaggagaaacaagcatgaaactgacccctaacttttaccgcgatcgcgtttgcctgaacgtactggccggttcgaaagataacgcccgggaaatctacgcggcggcggaaggtcatgtgctggttggcgtgctctccaaaaactatccggatgtggcaagcgcagtcgcggatatgcgtgaatatgcggcgcttatcgacaatgcgctctccgtcggattgggggcaggcgatcctaaccagtcggcgatggtgagcgaaatctcgcgtcaggtacagccgcagcatgtcaaccaggtgtttaccggcgtagggggcagccgggcgctgctggggcaaaacgagacggtggtgaacggtcttgtctcgccgaccggcacgccggggctggtgaaaatttccaccggcccgctaagcagccgcgcgccggacggcatcgtacccatagaaacggcgattgcgctactcaaagacatgggcggcagctctgttaaatactttccgatgggaggactcacctgtcgcgacgagtataaagcggtggctgacgcctgcgcccgccatgatttctggctggaaccgacgggcggtatcgatctggaaaacttcgccgagattctgcacatcgcccttgatgcaggtgtaagcaaaatcattcctcacatttatagttcgattattgataaggtgagcggcaacacccgtgcggacgatgtgcgtcagttactcgctatcgtccggtcgcgtgtcggctaatcatgaggagagagacgtgcgattccccaaccaacgtttagcgcagctatttgcgatgctgcaaaacgagacgctgccgcaggacgagctggcgcagcggttgtcggtctccacgcgtaccgttcgggcggatatcgccgcgctgaacatgttgctgacgccgcatggcgcgcaatttactctcagtcgcggcaacgggtatcaactcaaaattgatgatccggcacgttatcaatccctgcaaacgcagcaatctcccacgctggcgcgcggtccgcgcaccagccaggagcggatccactatttgctggcgcgttttttaacctccgccttctcgctgaagctggaggatttagcagatgaatggtttgtcagccgtgcgacgttgcagaacgatatggcggacgtgcgcgagcatttgctgcgttatcatctgacgctggaaacgcgtccgcgtcatggcatgaaattgtttggcggagagatggcgattcgcgcctgtctgaccgaccttttatggacgctggtgcagcaggagccctcccatccgttaattgttagtaccacgctgaacaccgaggtgtctcaacggctgcagtctcttttgccggatattttctctcattgtcaaatccgcctgaccgatgagggcgagctgtttctgcgtttatactgcgcggtggcggtacggcgtattcgcgaggggtatccgttatcggaatgcgtggcagaggaggtcgatgaaaaggtgcgccatgcggcgcatgagattgcggagctactacaacagctggctgacaagccgctgtcggagccggaagtaagctggctgaaggtgcatattgccgcccgccaggtacaggagattgcccccagcgccattaatgccgatgatgaagaggcgctggtgcactatatcctcaattttattaatactcagtacaactataatctgttgaatgataaacagcttcacgcggacttgctgacccacatcaaaacgatgatcacccgcgtgcgctaccagatcatgatccccaacccactactggaaaatattaagcagcactatccgatggcgtgggatatgacgttggcggcgatatcgagttggggaaaatacacgccgtataccattagcgaaaacgaaatcggttttctggtgctgcatattggcgttgggctggaacgtagttacaacattggctaccagcggcagccgcaggtactgctggtgtgcgatgctggtaatgcgatggtgcggatgattgaagcggtactggcgcggaaatacccgcagattgagattgcccgcactctgacgctacgcgactatgaggcgcgggacagtatggtggaggattttgtgatttccacagcgcggatcggcgaaaaagataagccggtcatcatgatcgcgccctttcctaccgactatcaattggagcagatcggtaagctggtgctggtggacagaacccgtccgtggatgctggataaatatttcgatgcctcgcattttcgcatcgtggagggggaaataaatcaacagacgctgtttaaaacgctgtgcgatcagttgcacgaggaaggctttgttgatgcggcgtttctcgattcggttattgaacgtgaagctatcgtcagtacgttattaggcgacgggattgccttgccacacgcgctggggctgctggcgaagaaaacggtggtttatacggtgctcgcgccgcaggggattgcctggggtgacgaaacggcgcacgttatttttttactcgccatcagcaaaagtgaatatgaagaggcgatggccatctacgatattttcgtcactttcctgcgcgaacgcgccatgacgcgcctctgcgcatgtcagaattttacgcaatttaaaacggtcgcaatggagtgtgtgagtcgcttttgagaggcgttatccagaattcgatgtaatgcgaatgtaatgctaaactgcattacacattcgattctcctggaggcataatggccacgctgaacgtccgtctggatgacaaactcaaaaatgaggcttatgccgtgctggaaaaactgaacattactccaacggaagccgtgcgattactgttccagtacgtcgcggaaacggggcgcatgccagtgaaaaccgtcactcttagcgacagtgaagatgcactgattcagacagttcgggagaggctgtctagtccgcaaaagggaatcaaggttagtctggatgacttatgaactggaattcgacccgagggccttaaaagagtggcataagctgggcgatacggtgaaggctcagcttaagaaaaagttggctgatgtgctattgaaccccagaatcgactctgcccgtttaaacggtcttcctgactgctataaaattaagcttaaatcgtccggttatcgtctggtgtaccaggttcgggatgacgttgtgattgtgtttgttgttgcggtcggcaagcgagaacattcagccgtctatcacgatgcaaacaaacggctttagcgatcaacgcaaatgatgcactacttggttgctgctaccgcgccagataagcgccgggtctttcagatcctgcacaaatttgccatcgaccagcacgttgatgagattgaccacctgcatctgtgcggcgttgagttcatcgagcctgtagccggtccacacccagatatctttccccgggcactccgcgtggatgcgttgtaccagtgccaggatatccggtacgttttgcggatgcagcggatcgccgcccgacagcgagatcccctgacggtgaatgcgcgtgtcgttcagatcggcaatgatcttatcttccatctctttggtaaacggctggccggaattgagccgccaggtgcttttgttatagcagccagggcattcatgcacgcaccctgacacaaacagggtgcagcgggtaccggggccgttaacgatgtcgacgggatagtattgatggtagcgcatagcgggtgtccagaaagcatgtaggccggataaggtgcttgcaccgcatccggcaacattgtgatgcctgatgacgacgcgattgcgtcttatcaggcctacggtctttgcaaacggaaattaacctatctgcccgttgcctaaatgcttcacgcggcgcttcacttcttcctgcttaccggcgttaaacggacgcgcgtccgggctgcctaaataaccgcacacgcgacgggtaaccgagacgcgcgcggcgtcgtggttgccgcatttcgggcaggtgaaacctttactggtacattcgaactcgccggtaaagccgcactcgtagcattcatcgatcggcgtgttggtgccgtaatacggtacatgctgatagctgtaatcccagacatcttccagcgctttcaggttgtgctgaatgttcgggtattcgccgtagcaaatgaaacccccgttcgccagcggcggatacggcgcttcgaaactgattttgtcgtacgggttgaccttcttctccacgtcgaggtggaagctgttggtgtagtaacctttatcggttacgcccggcaccacgccgaactcggcggtatccagacggcagaagcggtcacagaggttttcacttggcgtgctgtacagactaaagccgtagccggtctcgtctttccactgatccacggcctggcgcagacgctccacaatcgcgatgcctttagcgcgaagttgctcgctgtcgtacaggtgttcgccgccgaacagcgcgttaatggtttcatggataccaatgtagcccagagagatggacgcacgaccatttttaaagatttcagacacgtcgtcgtccgctttcagccgcacgccgcaggcgccttccatatacaggataggcgcgacacgggctttcacgccttcaaggcgggcgatacgggtcatcagcgccttccgcgccagcgccagacgttcatccagcagtttccagaatgcggtttcgtcgccttttgcttccagcgcgatgcgcggcaggttaaggctaatcacgcccaagttgttacgcccgtcgtggatctgctcgccgttttcgttctcccacacgccgaggaaactgcggcagcccattggcgttttgaacgaaccggtgactttgaccacctgatcgtagttgagaatgtccggatacatgcgcttgctcgcgcactccagcgccagttgtttaatgtcgtagttcggatcgccaaacttgtggttcaaaccatcgcggatagcgaagaccagttttgggaacacggcggttttgcgatttttacccagaccggcgatacggttacgcaaaatagacgcctggatcagacgcgactcccaactggtgccgaggccaaaaccaaaggtcacgaaaggcgtctggccgttagcggtgtgcagcgtgttaacttcgtattccagcgactggaaggcgtcgtagcactctttttcggtgcgagaacgcgcatacccttcggcatccgggatctgccactcatcggcggttttgcggtgcttgttatagctttcggtgacaaacggcgccagcacttcgtcgatacggttaatggtggtgccgccataaatatggctggcgacctgcgcgataatctgcgcggtaacggcagtggcggtagagatagattttggcggttcgatctcggcgttacccatcttaaagccctgggtcaacatgcctttcaggtcgatcaacatacagttgaacatcgggaagaacggcgaatagtcgagatcgtgatagtggatatcgccgcgctcatgcgcttgtactacgtcacgcggcaacaggtgctggcgggcatagtgtttggcgacaatcccggccagcaaatcgcgctgggtgggaatgactttactgtctttgttggcgttttcattgagcaacgcggagttagtttgctctaccaggccgcgaatttcctggttcagacgaccacgcttttcacgctgaatgtcacgatcgtgacggtattcgatgtaggcgcgggcaagctgtttgtacgggccggacatcagttggttttcaaccgcagtttggatctcgttaatatccacctgactgcgtgcgttcatttggctgctaacgacttctgcgacggtggcacagtaatctgcgtcatcgactcccgctgctttagctgcacgtagaatggcttccttaatgcgctctgatttgaatggcactttacagccatctcgtttcatcacatgcggtgtcatgatcactccatatttgtaagaacaggttatccacagaggccggggaagccataacaggtttattcatctcttttccaatgacttcccgcaatcctgacccaggttatccacaattcaccttgtgtcgagtgaacaggtgttgtagcaattgtagtcaattaatacaacatattgggtcggcgtgcattttaaagtctatatgtagtgatttgcatcaaggatgtttgcaattttattgatgtagaacaaggtaaaaatcagagcgtacagatggcgggcgctgtagcgtttgtaaaagatagcaagaaaaatctgattaattattcaacaaaaacagacagtaacctggagcaacgccacagcccgtgtcaataggtttgtggcgtttatccgtataaggacgtcgcgttagcgttgtaaccaccagatggcttcaaatgggcggagcgtcatcgcggctggctggctggcgacctcgccataattatgcagtagcgcctgccactgtcctttgatatgcggtggatgccactcctgacactggtcgctcagattggcgacaaccagcagggtttgcccctgccactggcgacgataacaccatactgatgggctacccgggaggagatcctgataatcgccccagatcattacaggctgggttttacgtagcgcaatcagcttttgataggtgtaaaacaccgagttttcatcgcgtaatgccgccgcgacattaacctccgtatagttatcgcacaggcttatccacggctcgccctgggtgaaaccggcgtttttaccgttgtcccactgcatcggcgtgcggctgttgtcgcgggatttactggccaggatagccagtagttcgtcggggtcgcgtccggcggcgcgtagcgcggcaaacatgttatggctttccacgtcgcgataatcggtgatgcgggtaaagtgtgggttggtcatgccgatttcttcgccctgatagatataaggcgtcccttgcataccgtgcagcgccatcgccagcattttcgcggctggaacccggtattcaccctcgtcgccaaagcgggaaacgatgcgcggctgatcgtgattacaccagaataacgcgttccaggcgacgttatgcatcccctgttgccattggcggaacaacgctttcagcgccacataatcaggttttgccagcgtccacttttcgccattggggtaatccaccttcagatgatgaaaattgaaggtcatcgagagttcgtcgccgctaagcgcggcatattgctggcagttttccagcgtggtagaggacatttcgcctaccgtcatcagattacgcggcgtaaaaacgtcacggttcatttcgcgtaaaaacgtatgcgtgcgcggtccgtcggtataaaagcggcgtccgtcgcccgtcggatcgtcaggaaaatcctgatctttggcgatcaggttcaccacgtccagacgcaggccatccacgtcgcgatcggcccagaattcgcagacctttttcagctcggcgcgcacggcggggttttcccagttcaggtcggcctgttcaggcgcgaaaaggtgtaaataatattgttcgctctggctatgccagcgccaggcgctgccgccaaatttggattgccagttattcgggcagacatccggcgtgccgtcgcgccagatgtaaaactgacggtatgggctctctttgttcagcgcttcgcgaaaccaggcgtgctgggtagaagtatggttaaacaccatatccaggatgatgcgaatgccgcgtgctttcgcctgcgcgaccagctcgtcaaaatcatccagcgtgccgtaggtcgggtcgatagccgtataatttgcgacgtcataaccgttatccacctgtggcgagatataaaacggcgtgagccagatggcgtccacgccgagtcgctgtagatagtcaaggcgctgcgtgacgccgcgtaaatcgccggtgccgctgccggtcgtgtcctgaaaacttttcgggtagatctgataaataacgccgttttgccaccagaggggaatagtcattgtagtttcctgcaagtacgttgggacgcaactgcgccccgaagaagaattagacaatttgtaatgtgccctgacgatgcttacgctgatagataaaggtggtcagaatcaccgggataacgatcgcgataaccatcgccatcgcaaacacctgccagtaagtcggctggatagagagaatgcccggcaggccgccaacgccgatgccgtttgccattacgccattcagaccacagagcagaccggcaaggccagagccgatcatcgcgcacagcatcgggaagcgatatttgatgttgatgctgtacattgccggttcggtcacccccagataggcggagatcgccgccggaacggaaatttcacgttcattgtgtttacggctggagatgataatgcccaccacggcggaggcttgcgcgatattcgacagcgcaatcagcggccagactggcgtaccgcccatgctctgaaccatctgcatatcgatagcgagcgtggtctggtggacgccggtaatgaccaacggggcatacaggaagccgaacagcgccgcgcctatcggggcgaaactgccggtcatcagataacgtaccgcaaaggccacgccgtcgccgatcatgcgaccaaaggggccgataaaggcgtgggcgagaaagacggccagtattaacgaacacaccgggacgacgaccaggtagagataatccggcacgatgcgtttcaaccgcgtttcaataaatccaagcgccagtcctgccagtagcgccgggataacctgcgcctggtagcctattttctcaatactaaatacgccgaagttccagacgtccggcgtttgctggcccagcagatacgcattcatcaactgcggcgacaccagcgtcacgccgagcacgataccaagaatcggcgtgccgcccatttttttcatcgccgaccagcagatccccaccggcagatagaaaaagatcgcttcgccgatcaaccataaaaaatcataaagcgtttttagcgccggatgcatctgcgccagtgtttgaccgtggctcatcggcacatcgccgatcacgttacgaaagcctaagatcaaaccgccgctgatcaatgccggtagtagcggaaagaagatctccgcgaagtgggaaattaactgctcatgccacttcatgttctggcgagcggctttttttgcctgctctttatcagcatacgctttgccggtggtctccagcagcgcgttatagtaatcgccgacttcggtgccgatcaccacctgaaactgcccggcgttggtgaaacagcctttaaccatcggcaattgttcgatctcttttggtcgggcgttcgcgggctggtggagcacaaagcgcaggcgagtaatgcagtggctcaccgtggcgatgttgtcgcgcccgccaaccaggtcaatcagccggtcgatatcggcttgttttactttgctcatcgtaaagcctcatggcagaggaggtaagttatgggttggcgcaagagtagctcttcaacgttggtttaaaaatgggaacgttcccgaaacgcggcgacgatcacaaattacgcatggtattccgtttaatcagccactcaggcgagggtagaaggaatgacgatccggcgcggatcgcagcggccattgatctgttcgatcagctgcaaagccgcctgccgtccggcttcagcatagccaggatcgacagtgacgatctccggatgcaggaattttatcagcggcgtattcccgatgcttgccagttgcagcgtctcaatacgttgctcctgtaaatacttactggcgcccaacgccagcgtatcggtggcgcagactaacgcggtggtatccggcatgatgacacttgccgtatgctcatagccctgcttcatggcaagaccgggaagggcggcgacgggatgaagtttatgttttttgcaaaacgccaggtatgcgtcatgccgacgtttgccggtggtaatatcgctatgaggaacgcccagaaagctaatgttgcggtgtccctgctcatacagccgctgcataaggatatgaatcgcgccctcgtcgtcgtaacagacggaggcaaaaccttgcgcatctcttgccagcagcaccagcgaggctttccagggggcgatcaactcttctgtgatgccggtaaagccaaacagcaccacgccatcaatgttacgtcgcctgagcatgcccagatgttccattaccagcatcggcgagaactgactttccatcataatagggtcgtagccctgttcataaaacgcaggcagcatggtctgaaccgcgaggttttcagacaacgaatcaaggcgagtgacgataatagcgaccactttatcgctttgtccccgcatcgcacgggcggagcgggacggagagaaaccgtgttgattcatcaccgcttcgacacgctcgcgggtacgtttgcttacgccgctttcattgttaagcacgcgggaaacggttgatttccctacgccgctcaggcgggcaatgtctttgatagtgagccggttttgcatcctgttttcccgtggcgtgacgctgatggtgataaaaagagtaactttactcaagcgaagggcaatgggcaaagtctggtttatcgttggtttaattacgtaacggtatgataccgccataattgccacaaaacttatggatttatgcgtataatccgcggcgcaaattatttacttaccggaggcgacatggaccctgaacccacccctctcccgcgatggagaattttccttttccggtaagcctgcctctgctgtcttaccggtgtgtaagacagtgacacaataacgtccctgtttttatttaaacattgctcatcgggcaaggctttgccgcgcctgaagaattttctgcgcctgacttcggcgcggagggattacctatgctaaaaaccattacccgccagctttttgcccggcttaatcgtcatttgccttatcgtctggttcaccgcgatccgctgcccggcgcgcagaccgcggtaaacgcgactatcccgccttcgctgagcgagcgctgtctgaaaatcgcggcaatggagcaggagacgctctggcgcgtttttgatacgcacccggagggattaaacgccgccgaggtgacgcgtgcgcgtgaaaagcatggcgaaaaccgccttccggcacagaaaccctcgccgtggtgggtgcatctgtgggtatgttatcgcaatcctttcaacattttactcacgattcttggcggcatttcttatgccacggaggatctgtttgccgcaggcgttatcgccctgatggtcggtatctcaacgctgctgaattttgtgcaggaagcgcgctcgacgaaagcggcggacgcgctaaaagcgatggtgagcaataccgctaccgtactgcgggttattaatgaaaatggcgaaaacgcctggctggaattacccatcgatcaactggtgcccggcgatattattaagctggcggcgggggatatgatcccggcggatttacggattatccaggcgcgcgatctgtttgtcgcccaggcgtcgctgaccggcgaatctctgccggtcgagaaagtcgccacgacgcgtgagccccggcaaaataacccgcttgagtgcgacacgctgtgctttatggggacgaacgtcgtgagcggaacggcgcaggccgtggtgatggcgaccggcgccgacacctggtttggtcaattggcggggcgcgtgtcggaacaagataacgagcagaacgctttccagaaaggaattagccgcgtcagtatgttgctgatccgctttatgctggtcatggcgccggtagtactgattattaatggttacacgaaaggtgactggtgggaagcggcgctatttgcgctctcggtcgcggtaggactcaccccggaaatgttgccgatgatcgtcacctctaccctcgcgcgcggggcggtgaagctctcgaaacagaaagttatcgtgaagcaccttgatgcgattcagaacttcggcgcgatggatattctgtgcaccgataaaaccggcacattgacgcaggacaaaattatgctggaaaatcatacagatatttccggtaagcccagcgagcatgtactgcattgcgcctggctgaacagccattatcagaccggtctaaaaaatttactggatacggcggtcctggagggagtagacgaaaccgccgcgcgtcagctctccggacgctggcagaaaatcgatgagattccgtttgattttgagcgtcgccggatgtcggtggtggtcgccgaagattcgaatgtgcatcaactggtctgcaaaggcgcgctacaggagatcctgaacgtgtgtactcaggtgcgccacaacggcgatattgtgccgctggacgacaatatgctgcgccgggtgaaacgcgttaccgacacgctgaaccgtcaggggctacgcgtggtcgccgtcgcgaccaaatacctgcctgcgcgtgagggcgattaccaacgtatcgatgagtctgacctcattctggaagggtatatcgcttttctcgatccgccgaaagagaccaccgcgccggcgttgaaagcgctgaaggcgagcggaattacggtgaaaattctcaccggcgacagcgagctggtagcggcgaaagtttgccatgaggttgggctggatgcgggcgatgtcgttattggcagtgatattgaaggattaagcgacgacgcgctggcggcgctggccgcccgtacgacgttgtttgcgcgtctgacgccgatgcataaagagcgcatcgtcactttgctcaaacgcgaggggcatgtggtcggttttatgggcgacgggattaacgatgccccggcgttgcgggcagcggatattggtatctcggtagatggcgcggtggacatcgcccgtgaggcggccgatattatcctgctggaaaagagcctgatggtgctggaagaaggcgtcattgaaggtcgtcgtactttttctaatatgttgaaatatatcaagatgacggccagctcaaatttcggtaacgtgtttagcgtgctggtagcgagcgcttttttgccgttcctgccaatgctgccgctgcacttgctgattcaaaacctgctgtacgatgtatcccaggtggcgattccgtttgataatgtcgatgaagaacaaattcaaaagccgcagcgctggaatccggcggatttggggcgctttatggtctttttcggtccgatcagctcgattttcgacattttgaccttttgtctgatgtggtgggtatttcatgcgaatacgccagaaacgcaaaccttgttccagtccggctggtttgtggtgggattactatcgcaaacgctgattgtgcatatgatccgtacccgtcgtctgccgtttattcaaagtcgcgccgcctggccgctgatggcgatgacgttgttggtgatggtcgtgggagtttcgttgccgttttcgccgctggcgtcttacctgcagttgcaggcgctgccgttaagctatttcccgtggctgattgctattctggcgggctatatgacgttaacccagttagtgaaagggttttacagccgacgttatggctggcagtaaacactttcgtcggggattcgccagcgtgcttaatccccgatatcgctaaccaaaccagatgcccgtaaagctcgacaagtttaacgcgatcggctttatctttaaatttcagggcttattcaagcaactgtagaatgctatatgcaggcataaaaaagaggaatgtccagctaagtttgtaaaatacattctctgcccccgagccagaacgagaggaggagatgtcccaccgctggatatgttttgcggatatgcgacgaaagcggcgaatatagctaatgcaataaactaagtaaggaggaatcgctaaggcggcagtgggtttaggaaacataagggtaagcaatatggctgcgataatgaagcataaaaagacgatcttcgcagtagattctatctgttttaattcctggcgtatgctttcagcatgtttctcctgccagcgacggagcgtgctgttgctaaatccatattcttcgcataacgccttattcggcacgccgtttttagactgttgcagaaaatcggcgatttgctcctcggtaaaacgcgctcttaccattgccgcctctccatggctgttggtgccccgaaccgggcaaacttgcgccgcccggcggggatgacgtccggcgcttagcgacgaacagcgatcgcttcaatctcaattttcacgtctttcggcagacgggcaacttccacgcaggaacgcgccgggaaggtcgcgttgtgctcggtgaagaacgcttcgtaggtggcgttgacggtcgcgaaatcgttcaggtctttcacgaagacggtcgttttcacaatgtcgcctactttcaggccagcggcttccacgatagctttaacgttttccagcgactgacgtgcctgagcggatgcgtcttccgctacggcgccggttttcggatcgaccggaatctgaccggaagtgattaccatgctacccaggtctacgccctgtacgtaagggccgattgctgctggtgcattttccgtcgcaatagttttgctcatgatttctcctgaattacagcggtaatagaatgtccccgctcattatagggagccgggatctcataaccaacccccattagttggccagcaccacattatgcgaaaactctttttcacagtatttgcatttgagggcgatatcattggcgcgttttttcactgcaaagctggaggataccggttccgcgtggctgatgcagttgctgttcgggcaaaccagcacattattaatacgctctggcaggctggggcgcgatttcccgaccacgtcgtagttgtcgatgcggttaacggtggcctgcggcgcgtacagagcaagttggttaacctgctcatcggtgaggaaggtgttttctattttgattaagtctttacgccccatctcgccagacgggagattcagaccgatagtgattcgctgatcggtctcggtcaatttaaacagactcagcagtttaaagcctacctgcgcagggatatggtcaatcacggtgccgcatttaatggcttcaacctgcagtttgttatcgtgtgtcatcgcttttctcccttacagactcagttcgctattcagtaccaacgccagtaacgcctggcgagcgaaaataccgttgcccgcctgttggaagtaccaggcgtgtggcgttttatccacatccgtggtgatttcatcaatcctcggcagcgggtgcagcactttcatattttcacgcgcgccgttcaggtcgctggcgcgcagaacaaactgcgccttcacattggcgtactccgacgggtcgagacgctctttctgtacgcgagtcatatagaggatgtcgacgtcggccatgacctcttcaatagaaccatgcaggctccaggccatccctttttcatccagcatatccagaatgtactgcggcatcgccagcgcgtccggcgcgataaaataaaaacggttgccgctaaatttcgccagcgcctgggttagcgaatgcacggtgcggccatatttcagatcgccgaccatcgcgatatgcaggttatccagacggccctgcgtttcctggatggtgaacagatccaacagagtttgcgtcggatgctgattcgaaccgtcgcccgcattgagcaccggcacctgaccggaaaactccgtcgccagacgtgccgcgccttcttgcggatggcgcatcacaatcgcgtccacgtaagtgctaatcactgagatcgtgtcggctaacgtttctccttttttccccagcgacgtgttggcgctgtcggagaagcccactacgctggcgcccaggcgatgcattgaggtttcaaacgacaggcgggtacgcgtggaggcttcgaaaaagcagctggcgatcactttatgtttcaaaagctccggctgcgggttggcttttaatttcgccgccgtcgccagtaccagattaagatcgtcgcggctgaggtcgtttatggaaatgatatgtttttgatatagcgggttagccatgtttatctcctgacgcctgggcaaaaaaaagcccctcaattgaggggcttggtattggttttcaacggaaagaaaaacggcaggcctgcgtcttttttcagacgcggtaagacagaatgtcgtacacactgaaccatgcttcctcccggcaaattgtccgcgattatactcagctctgttttgggatcaagcgaattaatgcatgatttacttgtcgcaaacggttcttatgaatttaaattcattttaagcaaataattaatttgtttgtgtaccagcgccgtgcgctgaacgatctgtggtgcgacccagacaatactgctaccggcaacgacgccgagaatttccggcaatgcgtggtaatccagaattctcgcgacggcgcgaccataacctgccgccgtatggataaggataaattcgctattatgttcaacgctgacgaccatttcggctattgaacgtccggcatccggcgaaggacgctgctggggatttacggaataaatcttttgtcctttcgcatttctgatttttattgcgcccagcagcttgagcaggcgcgaaaccgtagactgactgataccttcaaatccctcattttgtaaatcgcggcgaatctcctcctgggacaggtaacttttttcactaatcaggcgctgacaaaccgccagttgctgttgttctttggcggagtaatcatcgtatttcttcataaatgcaccttatctttattattgatatcaacggactggcgaaattcatcacatttgtcacattgattgcggatcaatcgggcggttttgcaggaaaatgagaagctgatcaaaaaaggtgacggcgtgcctgatggcgctgtgcttatcagtcctgtcggataagacgcgtcgccatctggctcgttacatcatcgctccgatgctcagtaccgccatattcagcaatgtcaggatcagcaacagcggcgcgacccatttcagatagcgaacatagggaacccgcgcgatcgccagaccgcccatgaccacggcggaggtgggcgtaaccaggttcacaatcccggaggccgactggtaggcggttacgaccaaatcccgctgtacgtgggcaaaatccgctaacggcgccataatgggcatcgtcaatacggcaagaccggaagaggagggcaccaggaaggagagcaatacttccagccagtaggttacgtttatgaaaatggtggtagagaggccggaaaccagactttccgcgctgtgcaaaatggtgtgggtaatcataccgttatccatgaccaccacaatgccgcgcgcgataccaataattagcgccacgccgagcaaatcccgcgcgccgtcgataaaggtactggtgaacgcttcctcgcccatccgcgttatcacgccaacgataatcgccgccgccagaaagacgccggagatttccgccatccaccagccgagaaccgccacgccgtaaatcatcaccgcgaaagaggcggcgaagatcagcagcacccatttccgggtagccgtaaactccagcagtgtattggcgcgattgccgaggaaatgggcgcggttttccgccattttatccgccacgatagaaagctcaggatgggcgcggactttgcgtgcatagcgcattacccaaaacacgcacagtacgtagccgacaattaacagcagtacacgcatcagcatgccctgcgtaaaagggatgccggcggcgttggcggcaatgaccgtggcgaaaggattaatggtcgaaccgagcgtgcctatccccgcgccgagcagtacggttgccgtcgccactaacggatcgaagcgggccgccatcatgaccggcaccagcagcgtgtagaagggcaacgactcctccgccatgccatagatagtgccgcctgcggcgaacagcgccatcagaatggggatcatccactcatctttgccgttgagtttgatagttacccgttcaataccggcatcaatcgcccccgttttattcaccacccccagaaagccgccgataatcaagacaaacagcgcgacgtcaatggcgccggcggtgtaggtttcgtggttatagaggccgtcaatcggcgccagtaaaacagcggtaatcccttgcggatgcgcgtccacgggggcatacgttcccgccaccggcacctcttttcccagcgtggcgttcatcgccatttggtattttcccgccggcacaatccaggtcatcaccgcgaccagggcaataagaataaacaggatggtataagcggtgggaaatttaaatttacccatgatgttctctcctgatatcacggatatgcgccgcgagggcgcatatcctgtgggattagtcgccgagcgtcgccaccatgaccgctttgatggtgtgcatccggttttccgcttcatcgaagaccatcgagcctgcggactcgaacacctcttccgtgacctccagtcctttcaggccgtaagccatttcgatttcgcgtcccactttggtgtgctcgttatggaaggcgggcaggcagtgcataaacttcacatcaggattaccggtagcgtttaccacctgctggttgacctgatatggcgtcatcagactgacgcgctccgcccaggcttctttgggttctcccatcgagacccagacgtcggtatagaggaaatccacaccgtgaacgccatcttcaacgctctccgttaaggtgatacgagcgccggtaacgctggcgatttcccggcactgcgcgaccagcgcggcatcaggccagaaggactttggcgctatcagacggatatccatgcccatcttcgccgcgcccaccatcagcgaattgcccatgttgttgcgcgcgtcgcccaggtaggcgaagctcagttccggcagcgttttgcccggcgcatgttccagcatggtcatcagatcggccaggatctgtgtggggtgaaattcatcggtcaggccgttccagacgggaacgcccgcgtattcccccagctcttccacaatgtgttgaccaaatccgcgatattcgatgccgtcatacatccgccccaggacgcgagcagtatctttcatggactctttatggccgatctgcgagccgcttgggccgagataagtcacctgcgcgccctggtcgaacgcggcgacttcaaacgcgcatcgggtgcgagtagaggttttttcaaaaatcagcgcgatgtttttgccgatcagtgtttgcttttcgcatccggctttttttgcggctttcagctcaatagccagatcgatgaggtgttggatttccgccggggtgtagtcaagcagcttcaaaaagttacgatttttcagtgaaataaccattacaatatccttgttaaaatgaattgcctgatggcgctgcgcttatccggcccacggttatgcgcgctctgtaggccggataaggcgcaagccgccatccggtaaaaagccttatgcgtcaacgtcggcggtttcacaccgaatcaaagtacctttctcgcccgcgagaatggcttgcccatccgccagcgagccgattccggcaatgccgcagcaatggctgacaaactcagcgcaggcggtcactttcgggcccatcgaaccggcgtcgaactgcatttcacgaagcagctccggcgtaacctgcgccagcgggcgttgggtgggtttgccccagtcgagatacaccgcgtcgacatcggtcagaatgagcagcgcgtcggcgtgaatttggctggcaagcagggcggcggacagatctttgtcgatcaccgcctcgataccgtggtagccatcggctttttccacgaccggcacaccgccgccgccgttacagataaccaggtgatcgcggctaatcagcgcgcggatggcatcgttttccacaatgcgtttcggctgcgaggagggcacaacgcggcggaaggcgttaccgtcggctttgaatacccagcccttttctgcctgtaacgcacgggcctgcgcttcgtcgtaaatggggccgatatatttggttggattgaggaatgccgggtcgttggcatcgacttcgacctgggtgagcaggacgctgatttcacgctccggcagatgattcttcagcgcctgttgcagcatgtagccaatcatgccctggctttccgcaccgagaatatcgagcgggtagggcgtaacgttagcgtaggcgctattttgtagcgccagcagccctatctgtgggccgttgccatgcactaacactacgcgccattgccgggtaagctgggcgatggttctggccgccagttcgatatttttacgctgaatatcagcctccagcggttcgccgcgtttgagcagcgcattgccgcccagcgcgacgaccagtgtgcgtttgttttccataacgtctcctttaaataccatcgcgttccagtggacagctcatgcagcgtgcgcctccgcgcccgcgacccagttcatcgccgggaatgggaaggacggtaatgccggctttgtcgtatttttcgttggtccagatgttgcgctcatagcccaccaccacgccgggacgcagggtgagcacgttattggcgtcattccactgttcgcgctcagcttcaaatgcgtcgccgccagtggtgattaagcgcacctgatcgatgccaagcgctgtttcaagagcatgaaccagcgtgctctcctgggttcgtttcagaccgccgcgtccgtctggcgtcagcgtccagcactgaacgtccgggcgaacgacttccggatagacagagaaggtgtcgatatcaatgtgggtcatgacggtgtcaaggtgcatgcaggagcgatgttttggcagttcaacggcaatgacgcgttccgcctgacgatgtttaaacaatgcctgcgccaggaactcgacaccctgcggcgtagtacgttcagacataccgatcaacaccgcgccgcggccaatcaccagcacatcgccgccctctaaagtggcgtggtcgtaattaatgttctcgtcgccgaaatatttaatgaaatcaccgtctgcgaattgtggatgccagcgataaatagcacgtaaattattcgtttcacgttggcgtgcaggtttcgccatggggttaattgagacgccgttatatatccagcaggacgtgtcacgggtaaataggtgattcggtaatggcttcataataaagtcattaatatcgtgagtatcgaccaccatattttttatggaggcggggatttcgccgtaagttaaaccgccgcttaaatggcgagccagttcacggtgcggcatatccgccagccaggcgcgaatatctgcggcaaaggtgggcccaaggcgataatcggaaatttgcgtatccagtagccaggctttagcgtcagccacatccagtgtttgggtgagcaggtcggttaacagcaacacttctatcccttgctggcgcagcgtgttggcaaaaatgtcatgctcttcgccagcgcgctctacggataatacatcgtcaaaaagtaattcctgacaatttgaaggggtaagtctttttaggctgagattgggacgatgcaacattacgctgcgtaattgaccgatttcagaaccgacaaaatgcttttccatcattataccttttacataatttcaagaataaagaaggagtggctgcaaatatttagcgtgcttgcagtcgcggcgtttcagttaaattcgggagcaatgattgaattttatttgggttgttaatgtgatgagattcacattaattaaggagtgctatttttcttacttaatatatgagccgggtcagagaaattcaaaaaacaataaggcattaaatgaattactacgcagctatatggtttgttattttttattgttaattatttgtttgttgtattgaatgatatttaaatcttaaccacttgaaaataaagtgattatttttaagggttgcataactatgcgtgagggggattttattatcggggatatttaaataatttaaaaataactatggatatagaagtcatttatgcagggagagcgaattgtgatcgctaaaacgtttttatgttaacgcctttaatatcaaagcgttgttagtgatggcaatttggctccgctgaggttaatgcataggtactgcataaagttgggcgaactattaacaatatataaacaccgctggcgataaacatgcgctggcgcaaaatcgatgagagtaagggtagtatggcagccatttttctcgtataaagagaaaaataaaacgctgttttaactaaggagatgcgatgattgttggcaatattgaacatctggaggcctggctgccgacggcgttacggcaggcgattgagcacgtcaacgcgcatgtcacggcaacgaccgcgccaggtaagtatgacattgacggcgacaggctgttttatatgatttctgaaaatatgacggagccgggcgaatcgcgcagcgcagagtatcacgcccgttatcttgatattcagattgtgctacaaggtcaggaagggatggcattcagtacccggcctgcgggaacgccgcacacggactggttggcggataaagacattgcatttttaccgacgagcgtcgacgagaaaaccgtcgtcctgaacgaaggtgactttgtggtgttttatcccggcgaagtgcataagcccctgtgcgcggtgggagaaccggcgcgggtacgtaaagcggttgtgaaaatgctgatggcgtaatattttgtgccggatggcggcgcctgcacgttgcgatcttgtaggccaaccgccatccggcatcataacgacattatttagacagcgtcgctaccattaccgctttgatggtatgcattcggttttccgcttcatcaaaggcaatgctggccgcagactcaaaaacctcgtcggtcacttccatcccgccatgtaaaccgtactcttcggccatttttttgccgagcgtggtttcgtcatcatggaacgcaggcagacaatgcaggaacttaacctgcggattgccggttaacgccatcatctggctgttgacctgataatcacgcagcagggcaatacgctccgcccatttctctttgggttcgcccatagagacccaaacatcggtatagataaaatccgcgccttttacgcccgaggcaatatcttcggtcagggtgatggcgccgccgttctttttcgccatggcgctgcactccgccactaacgcggcttgcggccagcaggcttttggcgcgaccagacggagatccaatcctgttaacgcggcggcttccagcatggagttacccatgttattgcgtgcgtctccggcatagaccaacgtcatctcgttaaaggctttacccggcagatgttcctgcatggtgagcagatccgccagtaattgcgttgggtgatactcatcggttaaaccgttccataccggcacaccggaatattcagccagcgtttcgacgatctcctggccatatcctcgatactgaataccgtcaaacatccggctcaggacgcgggcagtatctttgatggactccttatgaccgatctggctcccgctggaacccaggtacgtcacgcgcgccccctgatcgtatgcggcaacttcgaaagagcatcgtgtccgggtcgagtctttttcgaagatgagcgcaatatttttacccaccagcttttgttcttctttaccgtttttcttatcggctttcagtttggcagcaagctgcaacagagcagtgagttcactggcggtgaaatcaagtaactttaaaaaaggtttttggtaaaacgtagacatacttccctcacatggcttaggcctctcattgaattaaaattcactttatatggatgattattcatttgcaaccctgtttgataaaacttttctcgataaggtggaggcaacgtcggcggtatgtgacaataagagtatcggcaggacatctatgaggaacgagctatggcaaacccggaattactggaagagcagcgtgaagaaacgcggttaattattgaagagttacttgaggacggcagcgatccggatgcgctgtacactatcgagcatcacctttccgctgacgatttcgaaacgttggaaaaagccgcggtagaagcctttaaactcggctatgaagtgacggagccggaagagctggaagtggaagagggcgatacggttatttgttgcgacatcctcagcgagtgcgcgttgaacgccgaactcatcgacgctcaggttgagcaactgatgaacctggcggaaaaatatgatgtcgaatacgacggctggggaacctatttcgaagaccctaatggcgaagagggtgacgacgacgattatgtcgatgaagatgacgacggcgtgcgtcactaaagctgcatagtatgacggtacggcagcgtctgctgtcgtatttttttacaggttacgtatgaattacccgcaaatactctctccggtgcttaatttcctgcattgcccgacgccgcaggcgtggattgtccaggcccgcgatccgcaaaatcttcctcttctgcttaccgatcacttgatctgcgaactgaaggctgcgcaaaccgcgttgctgttggtgcgtaaatatgtcgccgataaatcgggcgccgacgcgctgctcgcctggctgcaaccttacgaggcgttcgcgtttcgtcaggggccggagccggattttgttgccctgcataaacagattagcaaaagcgccatgccgcaaactgatgacccctggggtcgtcagcttatcgaccgtatggtgttattgattaaagaggagttgcaccatttttggcaggtacgcgaggtcatgcaggccagaaacattccttatgtgaaaatcaccgccagccgctacgcaaaaggaatgttgaaagcggtacgcacgcacgaaccgctcaccttaattgataagctgatttgcggggcgtatatcgaagcccgctcctgcgaacgttttgccgctctggccccctggctggatgaggatttacagacgttttatctctcgcttctgcgctccgaagcgcggcattatcaggattacctggcgctggcgcagcagatttccgccgaggacatttctgcgcgcgtgcgctattttggcgacgtggaagctgaccttatcttgtcgccagaccgcgagtttcgttttcatagcggcgtgccagccgccggataaagcgtaaaattaaagattagcgtttttatcttttacgctgtcgccgtctgcaaaatttgtggtggtcatccgcccggcatcaagctgctggcgagcaggaaaagtcattttcatgatattctgtcctgagtaaagcctgccctgcggcaggcaaaaagaactcactcagtgttatattcccgaaaggtgaccgtgaacaatgccattattgcatcaatcactacgggtttttgtgttgaaatagttactgtttcacgccttttgacgcttcagagcaggtcttgccaacaaaggtttgtttaattttgttgatggaggttgttttattacctcctgcatcgacatccgatttcatggtcatcgcaaattctgtatcgcttattttcgtcgtttctacaatagagtgcgatttgacatcaggattattacacacagtctcattgatcagtttggtatccgtactttctacaaatgttgtcgtgcaaccgcctgcactggtagaaaaacccttcaccatttttttagaatcttcagacattttaggggtataacacataagcgtcgctatgcccgaatttttttcatccattaatacttcttttgtatctggattgatggtgcgcatttctatattttccattttccattcgccgggctgtatatctaatgcatatacattagagatactaataaacatagcggggaaaacaattgctgataataggcgtttcatttataacttccttgaataataagtgattcccggataacaggatgtttccgggattacttatatcagcaaaaataatacctggcgaggataaataaacgcctggttttcagagatcctttaacatcctcacttcgcaatcgacatgtccggtgcagccgagcggttcgctaatatgttcaaatcctaaacgttcgtatagcgcaatcgcctcgcgtaaaaaagccgttgtttccagatagcagcgtttaaaaccctgttcacgggcatgatccagcgccatcagcgccagctttttcgccagcccctgaccacgaattaccggtaaaaaatacattttttgcagttcacaaatgtctggttcgctacaggataacggcgccacgccgccgccgcccaccacacaaccgttttgctctaccacccagtaggccgcgcccggttggctataaacctgatacagttcatccagattggggtcggcaacggtataacctttatcggcggtaagtccgtattccgctgaaacctgacggatgacacgggcaatagcggcattgtcggcggtagtgattcggtgcaccgtgagcgttggcgaggcgacattattcataatatggctcaatttttaaaatttatttatagattactttaataccaccgtcttgagttacgcgcaaggagatcctgaatcagacaaaataaaaggcggaaaaattaaacaaaaatagtatcgtagtcaaatcagtaacaatttactggtttttattattaattctaatagattgtaattcagggatatgattcatgaataacgttatcagtagtaaagataaccataatcacacgttggtgtttacaggcaagggcggaaagtattttgttatttgccttgtgaatttcttgttgacgtgtatcacgtttggaatctatgcgccgtgggcgatggtgaaatgtcgacgttatatttatactaatatgacgctaaacaatcagccttttgcttacaaagccacgggcggcgcattatttattagtgtgttgttagtttttattatttatattgttagcctctcttttattgaacacggtcatcccggtctcggttttacgctattcggcttattaattgcgattattccttttatggcggtgaaaggattacagtatcaggcgatgatgacttcgcttaatggcgtacattttggattccagtgttccatgcggcgcgcctggtggtacatgttcgctcttccggtactcctgatggtggcgctttatattgttctttatattatctcactggtaaccatcgccgtcggcggtttagtgttcaatatcgtttttctcggtttgctggctattattgggataggggtcattaacggtattacctacagcaaatggatgaccttgtttggcaatggcgcaaactttggcattcatcgtttctcgattcaggttaatgttaaaacgtgcatcagagggtgcgtgttggcaatgttgaccctttttccttttgctgtcgtgattggttatctaatcgcgccggtgttcaccgacatgattcttttgagtatgatggggaatgcgcaggcaggaggggcgcttattctgcaatattatggccagataatggcatgttatttcctctattttctcgcgattattgtggtaaccagttacttatatgtggcgttacgcaacctgtttttaaacaatttgtcactggcgaacgattcgattcgttttcattcctctgtcactgcacacggtatgctgtggcggttactggtggtgtttgtgatttccggcgtgaccttagggctggcttatccgtggttgaaaatttggctggtgagctggctggcgcagaatacacaggtccagggcgatctggattcgcttgagttaaccaatgatgagaagccgctggaaaacagcccgctaatgtggatttctcgtggcatcatgccttacttcccgtttatctgatgtaaaaaggccgacgtttacgtcggcccataattcatgttgtcggatggtggcgtgaatgccttatccggcctaccgatcgcgccatgtcaataagcgaacgtgtaggcctggtaagcgaagcgccatcaggctttcagattacagcgcgctaataaccgcctgctgctcaatcagcttcgctttggcttctgcataaccgtccagcttctcacgctctttggcgatcaccgcttccggcgcgcgggcaacgaaaccttcgttggacagtttgccttcgatacgggcaatctcgccttcgattttcgccacttctttcgccagacgcgccagctcatcttctttgttgatgaggcccgccatcgggattagcagttcggcaccgtcgatgattttggtcatggaaaccggacctttgtcatcggctggcagcacggtgatgctttccagacgcgccaggttcagcaggaagctacggttgtcgttaacacgacgaacggcttcttcactacagccgcgcagcagcagttccagcggtttgcccggggcgatgttcatttccgcacgaatgttacgtacggcaacgatcgcctgcttcagccactcggtatcggccaacgcggcttcatccacctgcgcggcgttatattccgggaacggctgcagcataatggtatcggcggtaatgccacagataaccttcacgcgctgccagatggtttcggtgatgaacggaatgatcgggtgcgccagacgcagcaaaccttccagcacggtgaccagcgtatggcgggtgccacgcagttcagactcggaacccccggtcattaccggtttggtcagctccagataccagtcgcagaactggttccaggtgaactcgtacaggatgcctgcggcgatatcgaagcggaagttatccagtgcttcgcggtaggctttaacggtctggttgaattccgccaggatccagcggtccgccagcgacagggtcatttcgccgccgttgaagccgcaatcctgctcttcagtgttcatcagcacaaagcggctggcgttccacagcttgttacagaagttacggtagccttccagacgcttcatatcccagttgatgtcgcggccggtcgaggctagcgccgccagggtaaagcgcagggcgtcggtgccgtgcggctcgatgccgttcgggaactgcttctcggtacgcttgcggattttctccgccatctgcggctgcatcatgttgccggtgcgtttctccagcagttccggcagggagatgccgtccaccatatccagcgggtcgataacgttacccttggatttggacatcttctggccttcgtcgtcgcgaatcagaccggtcatgtagacagtatggaacggcacctgcggcttgccgttttcatctttgatgaagtgcatggtcatcatgatcatgcgggcaatccagaagaagatgatatcgaagccggacaccatcacgctggtgggatggaactgacgcagggcgtcggtgttttctggccagccgagggtggagaaggtccacagcgcggaggagaaccaggtatcaagaacgtcttcgtcctgacgaagctgaacgtcggcaccgaggttattttcctgacgcacttcgtcttcggtacggccaacgtagacgttgccgtcgttgtcataccatgccgggatacggtgaccccaccacagctgacgagagatacaccagtcctgaatatcgcgcatccaggagaagtacatgttttcgtactgcttcggcacgaactgaatgtcgccgttttcaaccgcttccaccgccggtttcgccagcacgtctgcacggacgtaccactggtcggtcagcatcggttcgataactacgccgccacggtcgccgtaagggacggtcagatcgtgcggtttaatttcttccagcaggcccagcgcgtcaacggcagcaacgatggccttacgggcagcaaagcgttccagcttctggaactcagccggaatctcgctggaataaacgttagactcttcacctttggtatcgaacacttccgcgctttcgcgaatgtcgccatcaaaggtcaggatgttgatcatcggcagggcgtgacgtttcccgacttcatagtcgttaaagtcgtgcgccggggtgatcttcacgcagccggtacctttttccatatcggcgtgttcgtcgcccacaatcggaatgcggcggttaaccagcggcagaataacgaatttgccaataagatccttataacgcggatcttccgggttcacggccacgccggtatcgcccagtacggtttccggacgggtggtggcgacgaccaggtaatctttaccgtctgcggttttcgcgccgtcggccagcggatagcggatgtgccacatcgagcctttggactcgcggttttccacttccaggtcagagatggcggtgcgcagcttcggatcccagttcaccaggcgtttgccacggtaaatcaggtcttctttgtacaggcggacaaagacttctttcacggcattggaaaggccttcgtccatggtgaagcgctcgcgctcccagtcaacggagttgccgagacggcgcatctgacgggtaatggtgccgccggattccgctttccactgccagattttgtcgataaacgcatcgcggccgtagtcgtgacgggttttaccttcttcagcggcaatcttgcgctcaaccaccatctgggttgcgatcccggcgtggtcggtgccgacctgccacagggtgtttttaccctgcatacgctggtaacggatcatggtatccatgatggtttgctggaaagcatgtcccatatgcaaactgccggtgacgttcggcggcgggatcatgatgcagaaggactctttgctttcgtcgccgttaggcttgaaatagccctgcttttcccagtgctcgtaaagcggctgttcgatatcttgggggttatatgtcttttccattatttccaggttgccgtattcaggttaaaaccagccacgcggtaggctttgtagcgttcgcgcgccagttgtttcaaagtttcttcgtaagggacgaagtctaccacttctgtgaaagcggtggcaaaatctgcaaagcttgtacgcaggctgattaaaatatcgcgcgggctgctgttgcgtttttgcggccaggcgatttcaaccggcgcgccgccgcgtgggccttcgcctgccagattgtgcgggacaaaactttccgccggtcttgcccacagcgcttcatccagccgaatggcctgcttctcatcttcgcaggcgatcagcacgcgcttgccagcgcgccaacgttctgcggcaatttcacacaccagttgttcaacggcgcttaaaccgttgacggtggtgtcattgtccagaagatagaacgtcgcattcttcatatatgaggcttcttgtggtggatttaaatgcgttgccatgatgcaccccgtaggccggataagcgtggcgccatccggcaaaacgcctgatggtggcgctaatgcgccttatcaggcctacggggtaatctcaaacttactcttcgccgttaaagcccgcacgattgagcaggaactgcgacagcagcgctaccggacgaccggtggcacctttggctttaccggaacgccaggcggtaccggcgatatccaggtgcgcccagttgtacttacgggtaaagcgcgacaggaagcagcccgcggtgatagcgccgccaggacgaccaccaatgttcgccatatccgcaaagttggactccagttgttcctggaactcatcgcccagcggcagacgccacgcgcggtcgcccgcttgctcggacgcgccgatcagttcatgcgccagcgggttatggttcgacatcagaccggtaatgtgatggcccagcgcaatcacgcaggcgccggttagcgtcgcgacgtcaatgaccgcttccggttcgaagcgctcaacgtaggtcagcacgtcgcacaaaaccagacggccttcggcgtcggtgttcaggacttcaacggtttgatcagacatagtggtcagcacgtcgccagggcgataagcgcgtccgcccggcatgttttcacagcccgccagtacgccgataacgttaatcggaagcttaagctcggcgaccatacgcatcacgccgtaaaccgccgccgcgccgcacatgtcgtacttcatctcgtccatcccttcagatggcttgatggagatgccgccggagtcgaaggtcaggcctttacctaccagcacgatcgggcgcgcgtcttcggacggattgcccttgtactcaatcaccgacatcagcgattcattctgcgaaccgtggccgaccgccagataagcgttcatacccagttcgcgcatttgctgttcgccgatcacgcgggtgatgacatttttgctgtagctgtcggccaactggcgcgcctgtgacgccaggtaggcggcgttacagatattgggcggcatgttgccgagatctttcgcagccttaatcccggcggcgatggccagaccgtgctgaatggcgcgttcgccgctggtgagctcacggcgggtcggcacattaaagaccatcttacgtagcgggcggcgcggctcgctcttgttggtcttgagttgatcaaagctataaagcgtctctttggccgtttcgacggcctgacgcactttccagtagttgttgcggcctttaacgtgcagttcggtcaggaaacagacggcttccatcgaaccagtatcattcagagtatttatcgttttctgaataacctgcttatactgacgttcatcaagctcgcgctctttgccgcaaccaatgaggaggattcgctcggaaagaacgttaggaacatggtgcagcaacagagtctgccccggttttccttccagttcgccgcgacgcagcaatgcgctgatgtatccgtcgctaattttgtcgagctgttctgcaatcggagaaaggcgacgcggttcaaagacgcccacgacaatgcaggcactccgctgtttctccgggctaccgctttttacactgaactccatgcactatgctcctgaatcttaaagacaacagtggtggctacagctatactcgtcgtctttcaagttgcagatgcgttggctgcgcctgctcatccctgtcgcttacctgatgtaagctccggggctccacagtcctgccgcctgcctgcaactcgaaatccattagagtatagaaattgaaagctttcgtaactcatatccgctgttgcggtgacttcgtgttaatcttaacgttattacggcattggcacgtcagaacaagttctgagaggtgaatccgctgagtataatgatcttagcgatgatttcgacgactcaagagaataaatgacgtttaagccatgaaacaagctaaattccagcaaaaaaatggttttttacgggcgtatttaaagtgataatcataagatatctggtgcgggagacgctcaaaagccagctggcgatactcttcatcttacttttgatcttcttttgtcaaaagttagtgaggattctcggcgcggcggttgacggcgatattcccgcaaatctggtgctctcgcttctggggctgggcgtaccggaaatggcgcagctcatcctgcctttaagcctgttcctggggctgctgatgacgctgggcaaactgtataccgaaagtgaaattacggtcatgcacgcctgtgggttgagcaaagccgtgctggtaaaggccgccatggtactggcgttatttaccggtatccttgcggcggttaacgtgatgtgggccggcccctggtcgtcaaaacaccaggatgaagtgctggcggaggcgaaagcgaaccccggtatggcggcgttggcgcaggggcaattccagcaggcgaccaacggcagctcggtgctgtttatcgaaagcgttgacggcagcgacttccacgatgttttcctggcgcaaattcgtcctaagggcaatgctcgtccttctgtggtagtggccgattccggacaccttactcagttgcgcgatggttcccaggttgtcaccttaaacaaagggacgcgttttgaagggacggcgttgctacgcgattttcgcatcaccgacttccagaactatcaggcgattattggtcatcaggccgtggcgctggacccgaacgataccgaccagatggacatgcgcacgctgtggaataccgacaacgatcgcgctcgcgccgagctgcactggcgtatcacgttagtctttaccgtatttatgatggcgctgatggtcgtgccgctcagcgtggtgaatccacgtcaggggcgcgtcttgtctatgttgcccgctatgctgctttatctgctgttcttcctgatccagacctccattaaatcgaatggcggtaaaggcaaactggacccggttatctggatgtgggcggtcaacctgatctatctggcgttggcgattggtttaaacctgtgggatacggtgccggttcgccgcctgcgtgcccgttttctgcgtaaaggagcggtataatgcagccatttggtgtgcttgaccgctatatcggtaaaaccatttttaccaccatcatgatgacgttgttcatgctggtgtcgctctccgggatcatcaagtttgtcgatcagctgaaaaaagcggggcagggtaactacgacgcgctgggcgcgggtatgtacaccctgctcagcgtacctaaggatatccagatcttctttcctatggcggcgctgcttggcgcgctgctggggctggggatgctggcgcagcgtagcgaactggtggtgatgcaggcatcgggtttcacccgtatgcaggtggcgctgtcggtgatgaaaacggctatccccctggtgctgttaaccatggcgatcggcgaatgggtcgccccgcagggcgagcagatggcgcgtaactatcgtgcgcaggcgatgtatggcggctcgctgctttccacccagcaaggtctgtgggcgaaagacgggaataactttgtctatattgaacgggtgaagggcgacgaggagctggccggcattagtatttacgctttcaacgatcagcgtcgtttgcagtcggtgcgttacgccgcttcggcaaaattcgacccggagcataaggtctggcgtttgtcgcaggtggatgagtccgatctgcaaaacccgaaacagatcatcggttcgcagacggtgagcggcacctggaaaacgaatctgacgccggataagttaggcgtggtggcgctggacccggatgcgctttccatcagcggtctgcataactacgttaaatatctgaagtcgagcggacaggacgctggacgttatcagttcaatatgtggagtaaaatcttccagccgctctccgtggcggtgatgatgctgatggcgctgtcgtttattttcgggccgctacgtagtgtgccgatgggcgtgcgtgtggtgacggggattagcttcggcttcgtcttttacgtcctcgaccagatttttggcccgctgacgctggtatacggcattccgccgattgtcggcgctctgctgccgagcgcgtctttcttcctgattagcctgtggctaatgctgcgtaagtcgtaatcacagtaatcgtaggcctgatggcgctgtgcttttcaggcctactccggacccgtaggccggataaggcgttagcgccgccatccggcagacagcttggtattcctcgaatgatgtagcgcgtaacctgacgcgtggcgcttttggctacgcgttaagcacaggcaagctgcgggaaagagcataagcgcagtagttcaaaaagttataatgtgttgccgtgataaatctgataacccaaatcaatcgtattatggttgagatcgttatttttaattttgttgagcaacatctgcgcggctctgcgcccgatctcaaaacgaggggtaattacgctggcgaggctcggtatcatttgcctgcccatctccagaccgtggaagccggcgatggagatctgctccggtacggccagttgacgctcgcggcaccacagtagagcgcccattgcgatatcgtcatttgtacaaaagacgccatccacgtccgggtgcgcagtaagcgcatcacgcattagctgtatccccagatggatagaggagatagcgcggggattgatgcgcaacggcgctagcccccggcgcgtcatcgcatcgcagtagccgtgataacgctgctcatcacggatatcgtcttttgaacccagatagagaattttccgccgctggcgtttatccagcatggtgctgaccatatcaaaggcggcctgacggttatcaaaccccacctccatatctaagcgatcgccctggatatccatgagttctacaatcggaagggtagctgagcgcaggaatttgacggttctgagggtatgatatttttctgaaagaataatgccgtcgatattgtaagacagtaaattgataacggactcttcttccgaatcgcgattgtaattgtaattcgcaatgagagtttggtagttatgacccgacgttacggattcaatcccggcgagaatgtcggcaaacaactgattctgaaaagaggggatcagcacgcccagagtgtaactttgcgcgtttaacagcatagcaggcgcgcgatttggtatgtagttaatttcctccatgatctgcgcaatacgctcgccggtttccctggcgacttttttcggcgagcggatgtaacggctcaccgtcatttttgtcacgccagcaagcgtagcgatatcctgcaaagaaattctgtgattcctcatgttttctccagtaccgggggcgggaacgtcgcccccatggttaattgggctgcggatgatgaattaatgcagaaccgcattcagcgccagtacgcccagcaaccccatgacagaaatcaatgtttccataacggtccaggtgcgtagggtttccccgacgctaagattaaaataccctttaaacagccaaaaaccgggatcgttaacatgtgatgcaataacgcttcccgcgcctgtcgccagtaccattaacgccggatcggcgtgggttacgttaataatcggcaatacgacgcccgctgtggttatcgcggccacggtcgcggaacctaacgcaatacgcagcacggcggctaccgtccagcacattaataacggagatagcgaggtgccggtcattaattgcgagatatattgacccacgccgctatccaccagcacttgcttaaacgcgccgccgcccgcgatgataaaaacaatcatcgcaatagcgccaatggactcgccgacgatatccatcacctgctcaaccgtacgtccattgcgtcgccccagcgtaaaaatggcgatgataatggcaataaacaacgccactgctggattaccgataaattcgaagaaaacccgcacggcattcgtttttggcagcgtgatttcacataccgctgcgatggccatcagaatgaccgggatcacggcggcaaaaatactgttccagaatgacggcatctcctcttcactgaatagatgaggattaaataatccttcaggcggcgctttttcaaatcgcgccagcaattttgaaaacagagggccggcaacaatcacggtcggtatggtaatgattaacccatacagcagggtcgtaccgagatttgcctcaaaaattgtcgcaatagcggtagggccgggatgcggcggcaggaagcagtgcgtaacggataaggcggcgaccattggaaccccgacatacagcaatggcagtcccgatgaggccacaattgtaaaaacgagcggcaacagcagtacgaatccgacttcaaaaaacattgccaggccgacgataagcccggtgatcaccagcgcccattgcacgcgttttttgccgaacgtattaatgagcgtcgtcgcaatgcgctgcgcggcgccggtatcggaaattaatcttcccagcatcgcgccaaaaccgccacgattgaggatagtgggcactgccccttccaggcagttaatttgattgccgctgatacaggcatcgcagtgtccgcagctgcgcgccgtccagccgattccaacgcgctggccgacttttagtcccttatcctgtgccgcgctaccgagtgcggccacccgaccgatgacctcgtgtccggcaaccagagggtattgagagaacccccattcattgtcgatcatcgacagatcggaatggcagatcccgcagtagtcgacccgtacctcgacatcttccggttggagttctcccgcgtcatattcatagagttcgagctcgccgcccgcctctttggcggcgtagctttttattatcgtcattgtgcttcccttaatgtggtgttgaactgaaaagtgtagagcatggaggcaagggacgcccggcgttaatctgctggagaaggcgggaagtagcctgattattctatttaatcctcaacgctgctgaaattttcagcacttagcgatacaggtgtatgctcgtgcttgcatggcggcgtatgacaggtataatccacaacgttttccgcatacctcttcagtgccgaagtggcgaaatcggtagacgcagttgattcaaaatcaaccgtagaaatacgtgccggttcgagtccggccttcggcaccattagtacttccaagaccatccgagaaagtccaattatcccttaaaaatcaatgattgaagcgatttttacgtcctgagtcgtccgaggttgtccgttgaaatccggaagtcattgggggcataattgggggcatcttaacttcgattagaaatgtgcccccaaatgaagctcaacgccagacaggtcgagaccgcaaagccaaaagacaaaacctacaaaatggccgatggcggcggtttgtaccttgaggtttcggccaagggatccaaatactggcgcatgaaatacagacgcccctctgacaaaaaagaggatcgcctcgcttttggtgtttggcctactgtgacacttgctcaggcaagagcaaagcgcgatgaagccaaaaagttgctagtgcagggcattgatccaaaaaccgaacagaaagaggctcaggccgagaactcgggggcgtatactttcgaaactatcgctcgtgaatggcatgccagtaacaagcgctggagcgaagaccatcgatcgcgcgttcttcgctatcttgaactttatattttccctcatatcggttcgtccgacattcgccagctcaaaaccagtcacctgttagccccgatcaaaaaagttgatgccagtggtaaacacgacgtcgctcagcgcctgcaacagcgcgtcacggctattatgcgttatgccgtacagaacgattacatcgactctaatccagccagtgacatggccggtgcgttatcgactaccaaagcacgacactatccagccttaccttctagccgtttccctgagtttcttgctcgccttgctgcatatcgtggccgtgtaatgacacggattgctgtcgagctttccttactaacttttgtacgttccagcgagttacgtttcgcgcgttgggacgagttcgacttcgataaatccctttggcgcgtaccggcaaaacgagaagaaattaagggtgtgcgttattcgtaccgtggcatgaagatgaaagaggagcatatcgttcctctcagtcggcaggcgatggttttgttagagcagctcaagcagattagtggtgataaagagctgttgtttccgggggatcacgacgcaactaaggttatgagcgaaaacacggtaaatagcgcattgcgtgcgatgggttatgacacaaaaaccgaggtctgcgggcatgggtttcggacgatggcgcgtggtgctttgggtgagtcaggattatggagcgatgacgcgatagagcgtcagttaagccattctgagcgtaacaatgtgcgtgctgcctatattcacacttcagagcatttggatgagcgtcgtttgatggtgcagtggtgggctgattatctcgatattattcagtatgagcatattacaccttatgaatatgcaagagtctgcaacataaaatgaatgatatttatagatgataatttaatggattaaaataggcacaattacttgtgcctattaattcaatctttccaaagaattacagggtgtgctctaggccatgggtgtccatcaaaagtggaataacaaacagtatttcttgttgaggtgtttgggtacctcgaaccgtatacactttccatactaaaaaaggagttagaaggtgtcccatcaataaatccacttatccctccttgaataagattattgacgcgaccgacatgacgttcttcggataaataacaaagggtttcacatgccttaacaagcgtttcagctgtaggcctcttgtccgagtcataacttaagcacttatctacaattttttgtagatcttgtgataaactttgatattgtggattggcagtcataaaggttggccattccattctattttttgttttaacattaacagcagcatctaaataaacgccaaatggatagtctcctgttaataatttaaacatcattgcacctaatggccaaatatcagttgatgcttctataggtttaccctttttaccaaacattaattcaggagacatgaagggtaaagcaccttttatcgtaccagaggtcgatcttgttaggtcaccactggcagcagcttcatcaaaaagttcttgtgttagcgtagctattccaaaatctgtaatttttagattcgaaatttgtactccgccagacaccattacattactcggttttaaatctctatgaataacatctgctttatgagatgccattattcctttagcaaggttatgtagtatacaagcgccataatgtgggtctaaaaaatcaaagtggcgcaatttttcctcaaggttttcaccttcaacaaattcttccgctaaaaatatattgccattatcttcaacataatcaaaggtttttgctatattgtgatggtttatttttgcagcgattttggcacttttaagaaatcttttgctttccaaaccaggaagtggagtctttaaagctaaatctaaatccagctttagatctaaaactttatatacgtcttgcatcccacctttaccaacataagataaaatcttatagcgttctgcaatgattcttccgacttcaatcatgatattacctccggtctagatatatcaaaggtgacaaagcttctagatttttcatttataagagtaattacactgcagctaggaaatactttatttgttatcacttgttggttattaattgtcgcacttcctgaaaaattacctactttaaagtcgaaaccatcatatactatttccatacttccactagtaccccaagtgatcgtaacacttttatttttagcatttatttcatatttctttccattcaggacgaagagggcacggtgtctatcttttaataggtatttagctatttgatctctaaccgaagacattgccggtcgagcatatttgtcatggcttaagcaactaatgaaagttctggctaagtcctttggaagtatctttcctaattcaggtatattggttatcgcggccgggggatgttcgtataattcatctggtttttctatgccgaataaatctaaaacgaggacaccatatgcataaacatcaattttttgatcgaaactaatgttttttctcttccatagttcaggagccatatatcctaaggttccaataacagaatgagtgaatgcttctgtgcctgaggtccttgctaaaccaaaatctaatattttaacaattttattctcgtctactctaatattattgggctttatatctctgtgaattactttagcagagtggatgtcacttaacccgcatgctatctgccataatttctttagtttttcggggtgactttctgacgggttataatttaaatccactccgttaatatactccagaactaatccttttttagttttttcggagactgttatgtcaattaaatcataaagttgtactacatgtttagaacgaagtttgagtagcgctttctgttcatctagtaaacgtctctcttcttctccatcctttaacaactttacaattacatctctatctaaatgattatccttacatattaaaatgtcccccatgccaccaccgagttcagtgctctttaatgaatatctttctggtaggacgtgattaatcttcatttttgttttcctcatccttgatatttatcattacagattggtcttttttgatcttttcaatagctttctttttatctttgttttttctttgtttgattgctttgcttgtaatggatggatcttgagatttttctggggattcgtttgagaatagctctctttgtggtgtttcagaatctaattctagattttttgttgaaggattgtttagtgtttttttattttcaaaaccatcatcgtctataataggtgaaggttctttatcttgatcatccactatattttgagagaagtaattctgcgctgcaggataatttttcatccacatgatatgtagattcccataagggtcccataactctacaccaatatctttatgggagttgaggctgttttctatatcattgcaattaataattccaaatgaagcgttatctttcgcaccgcaccattgaacatattgagctattctctgcgctgatgtagaaaaatcagatgaatgacttaataactcttcgaatgctgaatgagaaatgaaatgagttccatcggatgtcaatattatatttttatgatttttatctaagatattgatatgaggctttatagattcccccattcctataaactggagtaatccgcgccctctgccacccaatgcttctagagagtcatcactgctaattgctgtaagtccacagtccagagaaaagctatatattcgactgtcgccaacgttgacaattacaggagcagacccattttcaataattacagcggataatgttgaaccgccatgtccttttgcatagtcatatacaacggagtttgcttctaaagtcgcttttaataaccgagactcgggaggatcacttctaaacttaatcaaagaatagaataaagttgataaagcaattgttgcgcattgctttccatcttgcattccacccatgccatctaataacgccattgcaaaaaaaggattgccaacgtttgacggagtgttaactctaatcgcggctattagatcctgattctcagctctaaccagtcctatatccgtgctaaggacagcgttgaggtcttctggccggttaatgccgcttttggccgaagaacgagctaaccagcgagcaagtcgttctgtaaacatagtaattccgttttattgtgggggagtttactttcgcaatgagctaaccaattgtcaattaatacgaaagagctcgcgcgcaatgctctccccgccacgcctgcccgcttaagaggtcgcttttaatgcaggtgcatgaacgtcctcaggccgcaccagcactggtgttgcgtgggataaaaaatacggggatttgcatgcaaaaccatgcaccttatggatgcatggcttttttcaggaaaaatagcggaattttcgggggattttttcgcgtactaccgtgtggccagttctgcacgtcggcgggtgtaaatcaggttctgtgccggagtgaatttctcgcgattatcatcccgcgaagccgcatcaggcctgaatccgatggtcgttaacatatcgttgtcctgcacggaataattaattttttcacctgcggccagccacaccgacagggcttcacgcagataatcaaccgagtgctgcatggcgctctgttttactgcgggaatttgttcgtgatatcccatcagctcaggcgccagcgtggcggccagctccgcgccgtgctgctgcataaagtcatggagccggttgcggatgctgatgtgctgtacctcctcatgtgagcggatatagcgaccggcggcctgattaatctcccactttttcacgtcgatattgtcgcgcaaatcctgcattctgcgcgggatttgttcgtcaccggcaaggagctgttcacggtattcccgttcaaggtctgccagttcggctttacgtttcagccaggtatttttgttcgtctgacaggcctcaaaggcctgttgtatggtcacagtggtcacgagtctctctcctgattaatgccgaaacggcgagctgtagcagccctgtactttacgcggcggcggtggcgtcaccggcgcggggtcgggtttctccggtgcagcacgtatcacaccgtcaaccgactcaatggtgcggaaagtggccgaacattcgatattggtacactggtgataacgctgtttgacgttttccgacagataccggctggtacggacgtgcgcggtctttttgcagaacggacagtgaaacataattcagccctctgcctgttcgtggtcttttgcggccagttcagcggcaagcttcatccgtctggccgggcttcttaacagcgccatatcaaccccggttatgaccgggcgattcatgcccgttacggacagaaccggctcctgctccatatcaaaatgatacagggctgactgcatattcagggcatcacccagctcacgggtcacggtcgcacgcagcgaggtttctccgctcatttccagcgaccgaatacgcaacagaaaggcacgtaacagtgcggggctgataccggctaacgccttcttccactcgctgttggcgtaggtagtgaacgctttttcatgggcgctgatataagccgtaccggaggagcatgcaccaagcatggcgaggcttttgtctttctccagctcggtaatcagaccggtgaactcatcagccagttcgcggctggcgatacgtttactgtgttcagctttcagttcaggagtgaggttgccgcgcagagttcgaaagcggctgcgccagtcctgttcggcctgtgcactttcactgagggcggtctgtcgttcctgctcacaacgctgaatggaagcctcaatgtcgctgagtttacccatgctggccgtgtgtgcgtcttttgcttcgttaagtgcgaccagcgcaccggcaatgcgttgttccgcgccttcatcctgtttactgataacggtctgcatggatttgataatgagttcgggtttcatgttcaggctctccgtgtgttcaacctgaaatgattctgacgcctcctgcacaacaacacgattcattgccgttgtcagagtgctggcacaaacagaccttaaaaaccggctggccacagaaaggtctcaggaaaacctgactcaccgtttgtttttttactaataactattcaccactgttcaccttaaataaaaagataagtaatacagtgagttaaagggtgaatagttgaaggtctgagtgttcaccgtctgttcaccactgttcacccttcactttgttcagccagccagcttcttagattttttagcgattaaaaaaagaaatatataaacaaaagtaatcagcaatgggccaccggtttgccaacgtttgccaaaaaacggccaacgtttgccactgtataaaaatcgctctgttgtgtggtggagtactacaaaatgacttgttgccctgcgtaaaaatattcacaaaatagagagctacccgaagccggacggacacgaccggcactgtatggactttgtgaggtagcccgatgcacaccgctttttcttccccgtcttctgcccctgccgcgccgctgatgccggtttctgataccgttcatgagcgttttattcgtctgcccgaagtgatgcatctgtgcggtctgtcccgctcgaccatttacgacctcatcagccgggaagccttcccgaaacaaatctccctcggcggaaaaaacgtggcgtgggcgcagtctgaaatcacggcatggatgactgaccgcatcgcaaccggggttatgacgcatgatgatgaccattcagcaaacagcccctttttctggcttgcttctttttatcgtttccaggtatagttttcccgctgtcgcaaaatcggcagccgggcgtggaaacccgagtaatctaacggcgacacctgacgcgccatgcgtctttttttgtgtctatgccctcgtgcacctgttacttgcgcaatggtttcatgacctttgcagctatcgagtaatggtggctcaggcggggccgacttcggtcgggccggtatccgttagagccggtatttccacccccgtctgggctaccaccactgagcgtggaaactccggtggtagcataacctgctatctaacggaggttgcccttatggctacgatcctcaccccgtcatacccgcagtttgtctttgtgtttgccgctgttcgtcgcgcagaccgtaaaccccgtatctgtatgcttcgcaccgttgccggtgatgaacaggccgcacgtctttccctcgttcgcgattacgtcctctcgttcgctggtcgtctgccggttgcggaggtgcgcgcatgagacacaccaccattaccgcccgtgacctcgaatgtctggagcatatgcgcaacgtcggccagctcgtcaatgagctgatgcaggtgcaggactgcgccaccgttcgtcgcgacccggtgcagcagtcacagctcacctcggtgatttacctcatgaccgcccagcttgacggcgtggtagagcgctgcaatcagcgctggctgaccggggagggcaacgtatgaaaaatccattaccgcccgtattacgcgccgcgctgtatcgtcgcgccgtggcctgtgcctggctgaccctgtgcgaacgccagcaccgctatccgcacctcaccctcgacgcgctggaaagcgccattgccgccgagctggagggcttctacctgcgccagcacggagaggaaaaaggccgccagattgcctgtgcactgctggaagatttaatagaagccgggccacttaaggccgcaccgtcgctgtcctttctcgggctgaccgtgatggatgagctttgcgcccgtcatatcaccgcaccggtactgcactgagggagaaaataaacatgaaaatgaacgtaacggaaacggtaaaacaagcctgcggccactggtcgcgtattctcccggcgctgggtgtgaaggtgattaaaaaccgccatcaggcctgtccggtgtgcggcggctctgaccgtttccgctttgacgataaagagggacgcgggacgtggttctgcaaccagtgcggcgcgggtgacgggcttaagctggttgagaaggtatttggcgtgtcggcctccgaggccgccggaaaggtggatgccgtgaccggcaacctgccgccggttgccctggaagtgattgcggccgcagaagcagaaacggaggctgaccgcaaagcggcggccgcgctggccgtaaagctcatggagaaaacccgaccggccagcggcaacgcctacctcacccgcaagggattccccggtcatgagtgtgtcatgctgacggccacacacaaaaccggcggcgtgacgttccgcgccggtgatatggttgtcccgctgtatgacaatgccggggcgctggttaacgttcagcttattaattctgacggtctcaaacgcaccctgaaaggcggggcggtaaaaggagcgtgtcacaccatcgaagggaaaaacaggcgggaaaacgcctgtgggttgcggagggctatgcgaccgcgctcaccgtacatcacctgaccggggaaaccgtcatggtggcgctgtcctccgtgaacctactttctctggcgagccttgcccgtcagaaacacccggcctgtcagattgtcctcgccgccgaccgtgaccttaacggcaacggccagagtaaagccgctgcggccgcagacgcctgcgagggcattgtcgccctgccgccggtgttcggtgactggaatgatgcgtttatgcagaaaggtgaagaggccacgcggaaagccatttatgacgccatccggcctccggctgacagccctttcactaccatgagcgaagcggaatttaccgccatgagcaccagtgaaaaggcaatgcgggtgcatgaacattacggcgaagcgctggccgtggatgcgaacggccagctcctgtcccgatatgaggcaggaatatggaaaatcattcccccgtcggattttgcccgcgacgtggccgggttgtttcagcgtctgcgcgccccgttctcgtcggggaaaattgcctcagtggtggagaccctgaaactgattattccgcagcaggacgcaccggcgcgccgtctgattggttttcgtaacggggtactcgataccgccaccggcactttcagcccgcaccacaaatcgcactggctgcgcacgctatgtgatgttgatttcacctcaccggtggagggcgaaacgctggaaacccacgcccctcatttctggcgctggcttgaccgcgctgccggtggcaaaccggaaaaacgcgatgtgattctggccgcgctgtttatggttctggcgaaccgttacgactggcagctctttctcgaagtcaccggccccggcgggagcggaaaaagtattctggccgaaattgcgaccatgcttgccggggaagataacgccacgtcggccaccatcgaaacgctggaatcaccccgcgaacgcgctgcgctgattggcttctctctgatacgactgcctgaccaggaaaaatggagcggtgacggggcaggactcaaggccatcaccggcggggatgcggtctccgttgacccgaaatacaaggatgcgtactccacccatattccagcggtgattctggccgtgaacaataacccgatgcgctttaccgaccgcagcggtggtgtatcgcgccgccgggtgattattcacttcccggagcagattgccccggaggaacgcgacccgcagctcagggataaaattgcgcgcgagctggccatcattgtgcgtcagcttatgcagaagttcagcgacccgatgacagcgcgcacactgctccagtcacagcagaactccgacgaggcactcagtatcaagcgcgatgctgacccgacgtttgatttttgcggctatctggaaatgctcccgcagaccaacgggatgtttatgggtaatgccagtattatcccgcgtaattaccgtaaatatctttatcacgcgtatctggcctatatggaggctaacgggtacaggaacgtgctcagcctgaaaatgttcgggctggggctgcccatgatgctgaaagaatacggcctgaattatgagaagcggcacacaaagcaggggatacaaaccaatctgtcgctgaaagaggaaagctacggcgactggctgccgaaatgcgaggaacccgcagcaacataaccaactccagaccggcaacagccggtctttttctttctggacattgccacagggtgaacactccactgttcacccttcaccgtatattcaccctgtatcaccatgaaattattgataaaaaaccagaggtgaacagtgtgaacaataaaacctgaaaaaactttttatcaccctgcgcatcgcctgaccaggcgcatccaggacgagcaaaaatcacaaatgtgaagagtcgattgttcactcttcaccaactcatcaccacttatcaccatgatattaaaaagaaaagtgaagaggtgaacagtgtgaacagttatatggaaaaaaagaattttactgatgttcaatattaccccggttaggatccgtatatcggaacctaaccgatggggaaaataacaatttcctttttaataccaatcagttgtgaacttaaggggcttaaaaagccatgggggcacaaaagggggcacatgaacatgtgttcttctttatttcctttattttcaatttattatgttgtgttttgagtccggccttcgcaccatacaaagcttttttcaagtctactaacgtctactttaatccacaaaaacagtaagttaagcgaatttctgacttggcttagtctgttcacgtctactcaattccttgaacatataccaaccgatgatggtataactgatggtattcccggttcgattgattttggtaccaacactggaggtatcaactgatggctctcaccgatatcaaagttaggactaccaagccctccgacaaacccttcaaactcacagatgggcagggtatgcacctgctgatcaaccccaatggttcaaaatactggcaactccaataccgtttcgggggtaaactgatcctacccgcgtaatagggatacaaccttaagcgcggttctggttttcaaattgttccggactgagaccgccacaggcactgtggcgacgccagcgattgtaatcgcactcaatataattaaacactgctgcccgcattatttcccggctggcaaagtcctctccatgcatacattccaccttcagcgtgtggaagaagctttccgcacaggcattatcgtaacaacagcctctggcgctcatcctgccccgcagattatgccgtttcagtaagctctggtaatccgctgaacagtacttactgcctctgtctgtatatatggtgacttttccggtcgtttacgccgccacagcgctatgtgtaatgcatcgcaggcaaactgtgccgtcatccgcgaggacatagaccagccagtggctgactgcggccacaggtcaataaccacggccagataaagccagccttcaccggtgcgaagatacatgatgtcacccacccatttctgattcgggccactgacgtaaaagtcctgcttcagcagattctctggactggcagaccatgttcgcggtaactgactggactgatcttccgtgaagctttcgcccgcagcgcctgccggcgcaggctggccgctacggtatacacccgtccctgagcacgaagctcatccgtcaggcgtggcgcaccatagcgctgtttgcgtcactgaatgcctcccgggcgacgttatcacagacaaggcggaactgctgacgctggtttatctgatgacgacgctgatgccagacgtaccagccactacgggcaacctgaagtacacggcacatggctttgatactgaactcagcctgatgtttttcgatgaagacatacttcatttcaggcgtttcgcgaagtatgtcgcgaccttctggagaatagtcagttcctcatcccgttctgccagttgatgcttcagacggacgatctctgcggacatctcctattcgcgttcagaagaagagagctgattttgctgttttcttcgccagttgtagagctgcgattcatacaggttaagctcgctggtagccgcagccatcccaatgcgttagccagtttcaaggcttcgtcgcgaaattcaggcgtatgttgcttgcatggctttttggtggttgatgctgcttttgtcatgtgagacacctctttcttgagagtttactcacttagtcgcatgtccactcttgctgggtaagatcagacaacccattctctcaataaataacataaacatttttatttggatgtatttttttgtttatgctttttaaataaagggttgatatgaaattttttaaacatgtggatattagatattccacaaaaagtattaatggatcattcgcttattaatggggggggcgtgtaaagataaaaaaatagtgatccttgttttttgcttaaatttttaaaatggcgtgagtatattagcatccgcacagataaattgtgcgaatgctaatagttgatttttggagattttgtaatatgcgtaaatcagcatctgcagtagcagttcttgctttaattgcatgtggcagtgcccacgcagctggctttgttggtaacaaagcagaggttcaggcagcggttactattgcagctcagaatacaacatcagccaactggagtcaggatcctggctttacagggcctgatgttgctgctggtcagaaagttggtactctcagcattactgctactggtccacataactcagtatctattgcaggtaaggggcttcggtatctggtggtgtagccactgtcccgttcgttgatggacaaggacagcctgttttccgtgggtatattcagggagccaatattaatgaccaagcaaatactggaattgacgggcttgcaggttggcgagttgccagctctcaagaaacgctaaatgtccctgtcacaacctttggtaaatcgaccctgccagcaggtactttcactgcgaccttctacgttcagcagtatcaaaactaatttaatttaaactttataaatgccctcaatatgagggcatttggataattttattattttaaaaatatctattttgaatagataggttttatgcttccatgcaaaaacttaaagagggattatgtatattttgaataaatgtatacgtataactgttatctttttctttttttgctaccttccaattgcttcttcggaaagtaaaaaaattgagcaaccattattaacacaaaaatattatggcctaagattgggcactacacgtgttatttataaagaagatgctccatcaacaagtttttggattatgaatgaaaaagaatatccaatccttgttcaaactcaagtatataatgatgataaatcatcaaaagctccatttattgtaacaccacctattttgaaagttgaaagtaatgcgcgaacaagattgaaggtaataccaacaagtaatctattcaataaaaatgaggagtctttgtattggttgtgtgtaaaaggagtcccaccactaaatgataatgaaagcaataataaaaacaacataactacgaatcttaatgtgaatgtggttacgaatagttgtattaaattaatttataggcctaaaactatagacttaacgacaatggagattgcagataaattaaagttagagagaaaaggaaatagtatagttataaagaatccaacatcatcatatgtgaatattgcaaatattaaatctggtaatttaagttttaatattccaaatggatatattgagccatttggatatgctcaattacctggtggagtacatagtaaaataactttgactattttggatgataacggcgctgaaattataagagattattattttaaggtgtaaacaaatgaagaaaaccacaattactctatttgttttaaccagtgtatttcactctggaaatgttttctccagacaatataatttcgactatggaagtttgagtcttcctcccggtgagaatgcatcttttctaagtgttgaaacgcttcctggtaattatgttgttgatgtatatttgaataatcagttaaaagaaactactgagttgtatttcaaatcaatgactcagactctagaaccatgcttaacaaaagaaaaacttataaagtatgggatcgccatccaggagcttcatgggttgcagtttgataatgaacaatgcgttctcttagagcattctcctcttaaatatacttataacgcggctaaccaaagtttgcttttaaatgcaccatctaaaattctatctccaatagacagtgaaattgctgatgaaaatatctgggatgatggcattaacgcttttcttttaaattacagagctaattatttgcattctaaggttggaggagaagattcatactttggtcaaattcaacttggttttaattttggtccctggcggctaaggaatctatcatcttggcaaaacttgtcaagcgaaaaaaaatttgaatcagcatatatttatgctgagcgaggtttaaaaaaaataaagagcaaactaacagttggggacaaatataccagtgcagatttattcgatagcgtaccatttagaggcttttctttaaataaagatgaaagtatgatacctttctcacagagaacatattatccaacaatacgtggtattgcgaaaaccaatgcgactgtagaagtaagacaaaatggatacttgatatattctacttcagtcccccccgggcaattcgagataggtagagaacaaattgctgatcttggtgttggtgttggtgttggtgttggtgttggtgttggtgttggtgttggtgttggtgttggtgttggtgttggtgttggtgttggtgttggtgttggtgttggtgttggtgttggtgttggggttcttgatgttagcatttatgaaaaaaatgggcaggtccaaaactatacagtgccatattcaactcctgtattatctttgcctgatggatattctaaatatagtgtaactattggtagatacagggaggttaacaatgattatatcgatcctgttttttttgaagggacttatatatatggtctgccttatgggtttactttatttggtggagtgcaatgggcaaatatttataattcatacgccataggcgcaagtaaagatattggtgagtatggtgctctgtcttttgactggaaaacatctgtttcgaagactgatacatccaatgaaaatggtcatgcatatgggattagatacaataaaaatatcgctcagacaaacaccgaagtatctttggctagtcattactattattcgaaaaattatagaactttttctgaagcaattcatagtagcgagcatgatgaattttacgataaaaataagaaatcaacaacctctatgttattaagtcaggcattaggatctctgggttctgttaacttaagctacaattatgataaatattggaaacatgaaggtaaaaaatcaataattgctagttatgggaagaatttaaatggtgtttcgttatcgctttcatatacgaaaagtacatcaaagattagtgaagaaaatgaagatttattcagttttctactcagtgtacctttgcaaaaacttacaaatcatgaaatgtatgctacatatcaaaactcatcctcttcaaagcatgatatgaatcatgatttaggtattactggtgtggcatttgatagccaattgacatggcaagcaagagggcaaatagaagataaatcgaaaaatcaaaaggctacatttttaaatgcttcttggcgaggtacttatggggagatcggagcaaactatagtcataatgaaataaatcgtgatattgggatgaatgtttctggtggggtgattgctcattcatcaggaattacgtttggtcagagtatatcggatactgctgcactggtcgaggctaaaggtgtaagtggggcaaaagttctgggcctaccaggtgttagaaccgattttagaggctatacaatatccagttatcttactccatatatgaataacttcatatctatagatccaacaacgttaccaataaatacggatattaggcaaactgatattcaagtagttcctaccgaaggtgctattgtaaaagctgtatataaaacaagcgtgggtactaatgcattaattagaattacaagaacaaatggaaagccactagctcttagcacagttctttcacttaagaataatgatggagtaatccaatcaacatctattgttggcgaagatggtcaggcatatgtatctggattgtcaggagtgcaaaaattaatcgcttcgtgggggaataagccctccgatacttgtacagttttttactctcttcccgataaaaacaaaggtcagattagctttttaaatggagtgtgcaaatgaatcagtataattcgtcaatacctaagttcattgtctctgtttttctgattgttactggttttttcagctcaactattaaagcacaagaacttaaattaatgattaaaataaatgaggctgttttttatgaccgtattacaagtaataaaataataggtacggggcatctatttaacagagagggaaaaaaatcctcattagttcaagtttagaaaaaattaaaaataccccaggggcatatattattagaggtcagaataactcagcccataagcttaggataagaataggtggagaagactggcaaccagataattcaggtattggtatggtatctcattctgattttactaatgaatttaatatttattattttgggaatggaaacattcccgttgatacctatttaataagcatatatgcgacagaaattgaattataataaagggtgcgcaaattggcgcacctataactcttaattataaagcataaatacagctttttctcctgtatttctatgcttatattttagatggaattgttttggggttaaaccataatagtcagaaaataacttaatgaaatatgatacgcttgacattcctacggcatatgatactttattaatatgtgtgtcgctatcaagtaccaaacgcgctgctttttgcatcctggcatctagaaggattctgtaaaaattagtattttcattctcaagtttttttctgatagtcacttctgataaatttagtttttcggataatgtttttaatctccattttgttgaaatgtcattatctattgtttttctaacaatatcagaaaaactacgtgagactgaaatgcacagagatgtgtatagctgctcgatattattcacttttgaaaataaacaggcaatttcataaatatcgttgttgttattttttctcttttttaaatattcaaataaaattccattaattccactgtcggttataataaaaaccttatcgctaaatgttctgtagcgtattggtgataaactttctgagcaattagaagcctcaaataagcataaaactctacttaataattcatctggtaaagtaataatatcaaatgattcaatatcatccatatattcaatttccacaacagcttctatattttttctattaaggctatgttgcctctagttatttttatttcctctggctttgacttgttcttaatggtaataatacagtttttcgaatgtaaaatagcataacgatatagttttatttttatggcgttttttttcagcatggaattgcacctaatttttacgcttcactgcagaagccgattttatattattgtaggtattgttttatgatataaaaataactttattagatatgattagccgaagatgatgttttaaaatatctaaatacagtgtaagccatgtgtggttgttataagtgctttataggagttgttgtttcgttatgctcaattaattgtgttcatctatatccaacggagagccatgtgatatttcttttaatgccggtactgtacagtccgggcaggcttgattggacctataaaaatagatatgactatctcctaagattttaaatactccgtataaatgttgaatggggatactgaaatgcctttgatgtgacgtcttaaaggtagggctttatacataaccaatactcgagtgactctgatgaaagtgaatacgcataaatgaaccatcaaaatattcatatatttttacttttcgtcttggtttgaccatatcgtaatgaggttgctatagaatggattagtattattttgtggtagtggtaaatacatttattttaaccttgaagagtggggccgtttatgggtgaatccatcattacaaacatcatctccatcatccgggagcgtcagagtacggacaacgcgcctgttaaaatccgcgatattgctgatgctgccggactcagtatctaccaggtccgctcatatcttgagcaactccgtgctgtcggggtgcttgagaaagtaaatgccggaaagggagcgcccggattatggcgtctgctttgaccgctttcccggaagacggggacatcagccggatatggtacgatcggctttgtatcgaatttaacagcgacggcggactgagtccggctgaactgcgggttatccgactgctgctgcagggctataactgcgggcagattgctgccctctgttttcgcagcgtcaaaaccatttcagcccagaaaggcctggctttcaggcgcctcggcgtcaggaatgatgccaccctgttgccaaccctgatgcttctggggatggtgacactgtatacagacctgaaccggtgtcattcactggaggagagcggcccggaatgtgggtcggaagctggataagtatcactgaaagttattttatcatgttcatgaaattcgtttattacgcctgtctggccgtcgtcatattaatggcaatggtcttttgtgtgtcagtgctttttattctggaaaactcatgaccggaatattccggctgccggcttaatgaccgtgccggatgaattaagatttactgctgctgtcaggcggtaccgttaagcggcctttcattctgtatatctgttatccatggagtgtttccgtgacgatgaattatgcccgggagctgtttttcctgaggggaatattattttcttttttttttacctggccgcgcccgtcctgtgattgcgcaggagtgggagttcataactcccttggtggctgatgcccccgccgaggtggaactatttttcttttactgtccgccctgctatgcgttctcacagacgatgggcgtggcccgggccatccggcacgtactgccgcacggtgaccggatgatcaagtaccatgtcagcctgctgggccccctcggccatgagctgacacaggcctgggcgctggccatgatgatgaaggaaactgacgtggtcgagaaggccttcttcacggccgacatggtggagaaacgcctgcattccccggacgatgtccgtcgggtgtttatgtctgctaccggtatcagtcgcggggagtatgacagaagtataaaaagtcccgccgtgaatgacatggtggcattacaggaacggttgtttaaggaatatggcgtgagggggacgccttccgtgtatgtccgtggccgttaccatatcaacaatgccgccttcggtgcattctccgtcgaagatttcaggagccgttatgccgcggtggtccggaaactgctggccggtaaccctgatgccgactgatgataaaggcaccatacaggccggagatatccccccgctccgcgcgctgattctcctgctgctgaccagcgtctttatctccggctttctgaccggcgtcttggccatgctctggcttatctgccgtggggcatgatgtgaagtccggtctcccctgtaacagaaaacataactttcaccaccacgatgttcagatatttatgtaaccagaaagctgcactgctgaccgccattctcctgatggcggccggcgtgctcaccctgtgtttcccggagtcctggtacccgcaggaaacagaatggcagctcacggcagaaaaagaaattaccgggatacacggcggcctctccggcctgacatggaacccggacagcagaacgctgtttgccgtgaccgaccacctctcctcggtggtggagctggacacggaagggaacgtgctgcgggtgataccgtcagacggcgaccacgattttgaggccatcgaatacctcggcgggaaccgctatgccctgtcccgggagcgggagcggacgctcaccacccactgcattgacagcagcacgaccgtcctcccgccggcaacatacagcctgacgctggatgtgaacaggcacagcgacaatgccggttttgaaggccttgcctggggacggggagagcatgccctgatggtggcgcaggagaaaaaaccgctgcggctttacgtgacggaccggagccctgatgcgctgtcggtgagtgactcgctgacacaccgggcgtccctgccatggttcctgaaggatatctccggtctgcattatgaccggaacaacgggctcctgtatgtactttcccatgaatctgccgtggtcgtggtgtcggatctggacggcgggaggaaggtgatgtcgctgcgccggggacactgtggcctgcgaagggatatcccgcaggcggaggggatagcctcagatgaccgggacacgctgtggatagtcagtgaaccgaatctgttttaccgcttcacccgcacggcttcgtcctgaggatgaggcggcgcggaaggtgaagtaaaattcgccgcgtgaagccgaccggtgttggtgccggtgtcagcggtggattctgacagtggaaagatgatgaaaaacataacattcagcgcatcttttttcagggaattattctggtttgtggtgatggtgggaagctggttgatgaccttcccctgaccttccccctgtaaacagtgccagtctaaactgaagtttccggtctttcttccatctcacagagaggcgcattgccatgaaaaagacccgttataccgaagaacagactgcatttgccctgaaacaggctgaaaccggcacccgcgtcggggaagtctgcagaaagatgggaatttctgaggccacattttacaactggaagaaaaaatttgccgggccgggcgtgacggaacagcggcgtctgcggcaactggaggatgagaatcagcggctgaagaagctggtcgctgagctgagtctcgacaaggagatgctgcaggaggtactgaagcaaaagttctgaggccggctcagaagcgccaggcggttacatttttgcgggaggcttactgtatcagcgcccggttctgacgcatgtcgatcagtgccggagtatggattttgtgtcagataatctgtttaacgggcggcgttttcgggcgctggctgtagtggataattttagtcgggaatgcctggcgatccatgccggaaaatcgttaaaaggcgaggatgtggtcagaataatggaggcactgcgggtgccggataagcggctgccggtacgaatccagacggataacggcagcgagtttatctcaaaaagtctggataaatgggcgtatgaacacggcgtcacaatggacttctcgcgccccggaaagccgacagataacccgtttattgaaccatttaacggcagtctgcgggatgaatgcctgaacattcactggttcctgtcactggaagatgcgcaggaaaaacccgacaactggcgcagggaatacaatcatgagagaacgcattcatcattaaatgacatgactccggctgaatttatccgaagtctccggaaagacgaagctctctgatttagcactgtactgaatttgtgccagggtcattatcgacatgattaccggcaagcgcaccaccgcctgatgttagccgctcccgatgtttaatcgggagcggtttcgcattaagggactatcacctgcaccagcacatcggttgcccaactttcctcgctgttgaccacctgaccttcaacgcaggcttttgccatattcccgagctggaaagccacatcatcgttaaaatcaaaatcgcgatacgctcgcgcaaagacgatgcgccagtatcccatcccttggtcaaaacggatcttcagcgcctgaccattactgaaggtcaccatcagtttacgatggtgtggaatatcacgcggcgagccaacggtgttaaccacgacggctctgcccatagatgccgcaaaccactggtcggcaaaatcctgaaaatccgcttcactcatccagtcatggaacggcttgttgcctggccgctctttactcttaaacagcgtatcaatcgtcacttgcgcatcctgcgccaggatcgatttcagcggttttaacagcccgcctaataacgccagcgccaccgggttttgcagataacgatcgctatagtgaatgcgcgtcacctggttttccttcagcagcgtctgaatatcttcctgcgccccggttaacacgccccagaaacgctgaccaaattgagaaaccgggccattaagctgcttatggatctcaatatcgttgaccaggcctctgctacctgcggcatcggataatagctctgctttactaagcgttatcggctcaaacgcatggctgcgaataaccatctggctattcagatgccagttcgggccggggatggtggcctctgggctgcgagaaatcaacatcatcaggcgatcgttgaatgctacctgtgcgacaaccggcgtatccgtattcagctcagactggcaaagctgcataccaatggcggcaaactgcgcaatctcctgtaaaagctccggatcttcaatatgaccgggcacaaccagcgtaacctcaacctcatctttcagccgatagttctggatcgccgttcggaactggcgggcatacaaatcccactcgttaagcggcccattcatccacaacgtgagtttgcgcgccccgtcgttaatggcacgacggatagcatcctcaatgctgcctgggcaatactgcgcgtcggccagggagaatttttccgcctccggcaaaccgatatagtgactgaaatcctcccccagccaggcctgcgcggctttacgatccagctgatcgtgatcgtggcgggtctgcgaatcgagcagacattcgctacaggcggtatcacagtggcggcatcccagctgtttcaccatccctttgaggaccgcttcaatatgcaatggcgcactggaagcaaaccccgcaccgccgctgataatgtcgtaaagctgcaccgccaggaccgattgctcattatccagtctgaccggacgcaccgcatagcccagttctgtcgccgatacccccagcacgctggccagcgctcgacgtagtgtaaccgccagcgtcatggccacaatacggccttcatcagaattatcggggatatactccccgttttgcggacggcgcaaaatgagttcaaacacatcggtgcgcgccagcgcacccagcgtgacattcttattcagcgccgtggagccagggcagataatccgctgattctggctgtcgcgatcagatttaccggggcgcggaggataatgcgcttccatcgatttcggcgtatcggtggcattgagcattgactccgcccggccgcagctcaggcacagcgcataaccgtgtccaccttcgcccatgctctgctggaaaacatgaccatccgcgcctgacgccataaaacccatcagcgggtttggcagtggcacgcgttctgctttcacaaacacccaggcaggcaccaccgggatgaatttcattgtttcaatgttgttcgtaacgggagtatgggcatcggtgacaaaaccggcgggctgtaatacctgacgtcggttatccagcgtgatccgctccccgcacgcgctattggtacagaataaatcccccgagccaccaataccttcctcatagcctaaagtaccgcatttatggcaacgccaggcgctgtccagacgctgggcttcgttagtatcggcgttaaggttatgccagtgcagcgaaacaccggccgagcggaatacccgaccatcaaggataatctccgcgcccggcgcatactcacggatcgcaacggaaaggttgcgcgaaggcagccctttataacgcgaaacgttatcctcccggtcattcttatcacggcttttgtgcgttttctcgcggatataatcttccatggtgaagttatcaaaagtgacaacatccgttgggaagccatatccgggtaggaaagttcgggccgccagatcgcgtaacaggtattcaccacaatgccgttttttctccagttccagtcgcctgcggtacggcgtattgggctgcgattcactttcctgtttcacgagatcgcggaagatccccagccagcgtgtctgtaagacggcaatagcctcctgcgttttatcccgcagtttttctgccgtaacgccgtgcaatgccgtccctttaaccagacgctccagcgcgttatcaatgctcagcgtcggacgttcgagccaggctttaaaacgattgcataccgactggtcgagctcttcgccaaagaaccactggctattaaggctggtacgctctttttcggtttcaccgaccacatggcataagtattctgacagtaacagggaattgacgtgacgctgcaccagacgctctgagttcattgccaccattggagccgggatcaccgtctcaaacggccagaggggattagcaaaaacctgctgatcgtgcgggttccctttgcacaaggtgtacgaaatagcgcgtgactctttactacgcccggcacgcccggctcgctgtaaatagttggccggatgcggaggaacgttgttcatcaccactgcagaaataccgccaatatccacacccatttccatcgtggttgagcagttaaggacgttaagctgcccgtttttaaacattctttcgtagctttgcaggcgctccgacgattgctgtgccgagtgttctgcggtgcggtagtaaaatccaccttctaccacgcgatcgttaatgtccgtccagaggttttgcgagcgtaatggtagcacttgcggatcctggcttacccagtcacgcacttttgttaacccgtcgacataatcatcctgagagcgatcgtgttcccagatcgctggcagcgtgacttcctgagccaaaaacgcgtcgtactgtgcactcgtcagtcgctcgaactggatatgcatgggcaaatagggggtcagacctttgaaggttgtcgccagtaatttattggtcactggacaaatgcgtgctttttgcaccagagagaatgtcagatgctctttcggtaaataaaaacggtttccatcaggcttcaataccgccagagatcctgttagctggagccaggcttctttcagccaggcgttaacaatatcaatagttaccgtatttacggtgttaaatttggcccctaaaatcaacagcttgaccaggcgctgagtcacattaccgtggcgaatttgcggccagcgtttaacctggttgtcatctggctctttcgaatctgggttgcggacaaatttggaagagaaacggctaccgatccagtttcttagatcgtcatccagttggatgtagttgctttctctgacatagaaatccagcgtcaccttcagaaaatcgcgccagtcatcaagggttaagcctttagcctgccagtgagtaggaacactgtgagcctgccttctccagcccctgatagccaacctgaaccagcccctgggtttccaggctgttggttcgtttcgggcgtcgcataaactcacggaaaagcagcatttcggcgagtttcaaagggccgccattttcggtgaaaatttcaggcttcagataatggttatattgtaaaattggtccctgtatatcggctttctctttcagatcattgaccatttccgtccaggttcggcaaactaaaatggttgcagcctttccctccgtcgccgtctggattgcctgttcaaggcgttcggcctgagcttcagaaagttttgcttcctcgggcattccccactcgcgatactcccgggcttcttcacggtattgtgtcacccttgcaaccagtttcatcacgtcagcctggtcattcggagcactcgttggctgttttcgttggtgccagccaagaatttctactacgctaccacgtaatcggctgcgctctgcttcctgctgcatacgtactgccattcgcgccgtcccctgacgactgtcggtaaaggtaatcaggcgacgacctcgaccaggcaaagagagcgggccgacaccatctttaccttcatcactagtgaagtcctgacaatactccagcaccgtaggcacaatattggtgacataaaaaggcccgcccagtaacgcccttcggaagggctgtttaccctttccgcctttatagccacaattgctggcactacagatttgttcgatatcattaattgccagcggaatactgtccgggttcaccacgccgatactgcgggtctgacgatcgagccgctgcataatatagccagcttccgtattacattccgcagcaataatttgtggcgactggaatacaaaatccttctgaatcttttctccggatgtttcaaaatcgtcagaaatttcatcctgtagggagaattcatctccacctttattatcccactgtacgagtttgccttttttatcccgtgcaagaagatgcggttcattacactcattgcagaatgccagttcaaaaacgggactgccgcactcgcagttttgccgctgatttacatacacattgccaaaagaccagtttttttccagcgcggtattttttttagctgcacagttcttatccacacatgtccagatgccctgggtgtttcgctggaaaatatgtgctctgactttcagaaatgcaggatcctttgcattagggagtgtgccagagcaaagatcgatccagcgtaaaacatcctgctgcgtgtactgatgtttggtcagctcgttcaaacgctgggtcagcgtatcaagtttcattggtcggggttggctaaccagcatttcgcgtaaacagcgcgcttccggagagtgggtcaacgcactataacgctccggactgatctcttcactctccgaatcagggatatgctcaatctcatccagtgacagagaatattgtttgcagggttcgagctcaggaataacgcggcttccgcccagaacatcaatacgttcctgtggcactcctgacagctcagacaagaattttttcagctgcttttcagcatcacttccggcaatggtggccgacgtcgccacaaagcgaacatcatcaggcgtgacgccaaatgccgtcatgacgcgacggagctgtagagccaactcagcggcctgagaaccaacgtaggtatgggcttcatccagaactatccagcgtaatgatttttcagcttttgatttctgaataatcggtgcatcaacctgacgaaccatcatgtattccagcatggtaccgttggtcactaaaatgggggcgggttcttcacgcatcttctctcgtgacaaaacctcattaggcctgtttgcctgctcacttttgaccaaagcgtgcaattcttctgtgttaccgttatacagacagtaccgaattccggaaccaaaactacgggtccacgcatctaaacgctcgcgctgggaattaatcagggcattcagtgggtaaagaaaaagtgctctcacacctatcaacggttttttgttcttgacctgaagctcacgatagaggtcttccagtaccgggaccataaagcattccgttttgccagagcctgtcccgctggtcaccacgactgagtgttttttctcaagtaatgattgccagctggctaactgatgcgtgaaaggtttccagtcagagccaaaacgataacgaccattttcctcactatccagcgagtccaccacctccttgcttagcaacgtttgttttgttgcaaggtctttcattgtgctgttggactctttccagccaaatgtctgttcaaatacgggggaggcaagaaacgatccttctttcccgcaatcggccgccatttgttgcgtgagatgctcgcgaagattcgggttggtcacccccataatactcagcgtcgcctccgtagaacgcgacagtgattgttcaatcagcgaagaaaaatagcgtgtagtcattcttattcctttttatttttcagtaacattacgcaatagacagtattggaaaatggcgttaaaccatcgtgagtcaaaatctctaacctgtctcaagaaaaatacggcgccgggcttattctcaaaaacactttcaaatgttgttttaccgctggcaacagcagcagcaaatacggggagcaaggtgacggaatagcggtagctggcatcaggggaaatatcgataacaggattttgttgcgacatataccaacgtaaaaggcctgggccaccaaattctggccagcgagattcaccatgttcgcgtagaagttcctgataccactcaaggataatacctttcatcgtcaactcaggaaaaaccggtggtaatttcccttgactcaaccataattgcacctcactggcataagtcgggaatgttgtgcccagctgttgatacattctgtacagcaaccttatctgcatttcctccggtgcacctttatgagtcaaaaaagcacgaaaacgtgtggcggaacgtttaacttctgtaatggataaaaactcccagaaaacgggaaactcactttcaatacggctgagataatcaatggacatttcaaatttgaacagcgacatcgccaacgcttgtggatgctgaacaagtgcccgccatacttcaaaggtagccaaaggtaaatacccgaactgatcgtataaattgcgtaagaactgccagcccgagtgtgccgggtcgctcgccatttgttccagaactaacataatggtgttgacatctgaacgaggattaaaaagctgcgttgctttttgtaaagactgtattgctgtcgcgtcgctttgaattaccggctcacctgcaataaagcaaggtcgaaatgaggcttcttcacctggtttcggcagcaccagccatgggccattcttttgtattatcgaacttagttcaaattcaccaactggtacaccttcgctcattcttgacgtcagcagtacaacttttctctccggttcgctgagtaacataatgacgggcgaagggatctggcctgtacgattacttattgagtttgcgagaagaatctgcctgccacgatcatagtccagactatatttataacgtcggatctgccaggtaaaagaactaccacctccttttatgcgcatatcaactgtttgatcaattccttcctccagggagagtaaattatcaatatgttcccttaagctatataaagtaagctctaccggacattctcccgcactgtagtgccactcataccaggcctgcattccactacgcgaacgtaaacgtagttcaagctggtatcgcgtaggctcaccattttttccgaaaagatatgctctggcacccagaagatcgttaatcgttaaatttttcgggagaggtttctcatctttatcgaacgcaagacagcctcgtgcaggaaatggtaaccaaataacaatcgggtttgcagtgaggtttggcgttatttgtaatgaaattgatgcaggaggaatgccctccgccttcatcattatttctgtactatcgggcaaccgcttccgtccaacttcaagtgttttttccttcaagctatacaaacaagggtgctgagtagtaataatgacagaaccttcgttcgcctgttgtccattttttatttccagactaaaatcattggggagaatgccaattttcttacgcagtaacgtttcatcattttcgttacgcaccgaaataaactgtgctcccattttttcttgtacatcacaattttctataaatgttccgttgaaaaaacgcttgtaatggcgcgttgatagattctcagaatgttgagtaattccaggaacaccgaggaagagttcatccggataacttgtccaatttaatcgcttcccctggaaagagaatccagtatggataatctgatctcttcctatctttatccggtacgtttcatcgcctttaatgatgatatcctggcgacctttgatggtcagagcatggcatcccaaagccgaaaagccagagtcacaatcctcatgttctgaagccagacagccatcctttggcagcacaataagtacatggctgccacgtacgctgcaagaggcttgtccctgtaacagccattcatttttatcagaaacaaaaaccaatggaacatcgccaaccgcaacttcactgccttctaaaagattggagccgaaaaacatacccccagctctcgccacaataaacaaactgaccgtgggatttcttcggtaaaatttaatctcgcgcttacgaacttttatttttgcctgggagttacttagcgttgcatatgcaggtcccagacttgcgatttcgttaccatcttcatagatagcaagctcgaagcgcgttgttgaaggctcaatatcaattgaaaaactcagttcttcaggcagagaaatgagtgcctggagggcttcaggatgattttctgaccataaaaactgacagagagtggttttattcttttgaaggcggggttttgattcagtagaagctgttcgtaaaagtccattaaggaaactggtacccgtatcatcatcgagagggacagggaaactgtcacgccacttaggatgaacacgttcaagttcttttacgggttcggtatgattacttaaatcataaatttgaacaagagatactaactgttcagccatccgactaataagctcaactgaagtatcctctttgaaaacgactggcagggatgatttttctaccgctgcatggactaacgcgaacgtggaaatgttagaagatttagcctgatcgtattgatttagaatgagagaaaacatcgactgaaaacggctattagattcctttagcaacctgaaaggtagaccgccttcactgaataaggagcctaagaaattccgcctttctgtgtcataaaaccgcactggacgcccccagtaaccatccaggcctttagggataattttccccattttcgaggaagatgctgagatacctatcgtcttgtaaattggctcccatgcccatccatactctctttcataatctcttcgataccactctgagcagaacaatgtgaaacaggctgcgtaccctttatcacttttataaccatcgggtacccctatagctcgcagcagccgtttcaattcatcatattcttcactcgttgcgtggtattcatataacggacgatggtctggttgcttcaatcctctgcgggtgaggaatttagctagccatggggtacactttagaatggatgcgtattcggactgactcaaagcaagctccttgcattagaacagtgaatggctgaaagttattataactttttgttattttgaaaaaacagataacaataattgaattatgaatttaattaaatttgaaattgatattagtttgattttaatcaataagttaagtttattatacggaggggctactcgccatttgttttaatctgtaaggagatgatttgtagctacaaatcttttcaaccccatatcatcccattgaacctccggccggaaccgtctttacgatggttccggccttctttttacctgcctgcctacaaaggagtgatatggagctgaataacgaataccaaaactacgaagacgaggacgacgaaagcgctgacgacctccctccatcccaccacccgcgctctttccagtccatcatcggttggctctacgacaaagcagtcagtggtatcgcaggcatcgaatccgctgaaatgcttgccgcccgttatcttgaggacgcgaaagggtgatgcacagctcgccgcccgcaccatgatccactgggagagcatcatcgcaactatgtgctcatgaattcttcaatgtaatgacctctgacaaaaccctaaagcaagcgatatcaaatattactatttggcgcaaaggcgaacagcgagcgccgcataagccgttattgctgttatatgttctctcgcactatcggcagggtcacgatcgtctgtttgattatggttctgaaattcatgagcaattgctggatttgctggagcgctatgggccacagcgccgtgaacagcgcccggatatgccgttctggcgtctgaagggcgatggtttctgggaattgcaaaacgcggaattctgctcaaccagcggtagccgccagccacctaaacgtgaactcattgaatataatgttgctggtgggtttgatgccgtcaatttcgcgctggtaacaaaaaaacgtaagctaatcgacacgctggcgcagcagatccttgaggcgcattttccgaccagtattcaggaagacatcgctgacgagatgggttttgatattcgcacctctttccgtcaacgcgatccgaagtttcgccaggcggtgctacgagcttacaattatcaatgtgcggtctgcggcttcaatatgcgccacgacaacgcccctatagcccttgaagcagcccatatcagatggaagcagcatcatggtccttgtgaagtacctaatggcctggcgttgtgcgcaatccatcataaagcgttcgatcgtggttcgattggcctggatgaaaatatgcgcgtagtggtttccgacgcggtgaatggtggcggagtggtacagcggttgttctgggattttgcggggaaagagatcgcgttgcccccggttaaagaaaattatccgggtgagcggtttgtggaatggcataggaaagaggtgttcagaggagagcattgatctgggggagtattttgagtgtggtatacgttatctgttaaaaatagctccacatcaaaagcatcgaagtaatcggccacggttctcgcactatggtctgtagcgcgctggtggagtcacacctgtagtcaggcgacgcgtagagcgccagatgagccatcatgagcgcaagcggaatttatgaggcgcggcatcttaaagagcacagggagattgtaagtagcccgatattgctggcttttgcttatcttgctgacgggattcgtcgtatgaagcatgagaattacctcatgttttatataaggattcaacaccatatcaaaaccggtagctctcaacctttcaaggctatgtgtcagatcaagtggcaactaataaacataaatttaaaaacttatatatctggccagatagacttttttataacagctttataaattaaacaaatctgccatagagacagatttgtttaatttataattagaggtttgcaacgttatgatatactttttgcacatcatcatcatcttcaagggcatcaacaagtccttcaaagatttctaaatcttctggtgaaagttcaacgtctgattgagcaatcatttctaattctgttgttgaaaattcagtaattccagcggcttttagcgctgcaattcctttgtgcaggtctgtagcttcagtataaataacgatgtttccttcttcttcggttacatcacgaacatcaacttcagcatcaagcaaaatttcaaaaatatggtcagggtctgttcctttaaatacaatcactccagtattgtcaaacatatagctgacagcacctgcagctccgatattcccgccttttttattaaaaattgtgcggatattagcaatcgtacggttaacattagacgtcaacgtttcagcgataaccattgaaccattgggtccaaagccttcataacgcccttgcacgaacgtttcatctccgccacctttggctttatcaatggctttatcaataacatgttttggaacctgtgcttgtttcgcacgttcaataacgaattttaaagctgagtttgattccgggtctggttcaccttgtttagccgcagcatagatttctacaccaaattttgcatatactttagacgttgcaccgtctttagccgtttttttagcaacaatatttgcccatttacgtcccactggaaacatctcctcaaagaattatttacattaatggcaggttaataacctgcatatttttctaccgtattatatcataatatataaattctcgtctatgagaaataaatacatccagcttttacgaggggggtactttgattttaacaatggctaatatggtgggtaagtcattttttaattttcttctggttctttttttattcttaataattgaatcgcaacaataacgtcttattgatggtggtttcgctcatcaggtgaggtggaacgcttgcacgtcttgcgacatattgtggcagaaacttaatggcgaaattaagacgatatattcccgccttgagccgtgttaatttgttgaatacttttaaatggaggtatacctcttgtagggtatacctcctgcttcacgttatcgcgcgattaacgcaaatacgccccagccaaagtattctcgcgtccaggtgacgtgacgtttgggggctgccgtcagttctgttcgaacctcttgcgcaaactcatcgtcagggttttcctccagccagcggcgcatggtcatccacttagcggcttcatatctgtcccagccttgcgggtccgccagcaccatttccactacgtcatagccgagttggtcgaaaaaggcgaccagctcgggcagggggcgaaaatcggcgacggatgagacgccacaggcgtgggcgatctcttccgttgcggggatctgacgccagtacggtttaccgatgagaatgatcccgccaggtttgaggcttttggccagcagatctattgtccccgcgacaccgcccgcaatccaggtagcgcctacgcaggccgccacgtcatatttttcctcgtcgatataaccggccgcgtcgttatgaataaaatgtacgtattcactgacgccgagctcttctgcacgttgttttgcctgtgtggtgaagagcgggcttatgtcaatgccagtacctgtaacaccgtaatcgcgagcccaggtgcagagcatctcacccgaaccgctaccgagatcgagaatccgcatgcctggtttcatgcgtaacgcatggcccagcgtggcgtacttttccgctgtaaacggattatggatacggtgttcgctttcgctaatggtaaaaatacgtgggatatccattgggttattccttttactgagggcaataccctcagaagtggatgctttttcagccagcagcgcaaacagcttgcctgcaaaagtctcgccgaccggccaggtgtgactgtccgggcgctgcaacacagtgaagccagcatcaccaagcaggctgatatattcatcatcgcgccaggccttcatttgactgccgaaacgggtggtacagccgttttccgctatcgcccagaactgcgttgagctggtttgggcctcttcatcccaggcattttccgttaacagcagatgaggcacggcaagaaacaggccgtgcggacaacgctgccagcctggctgcgccatgccctggcgtttaacttcatcgaaggtatgcacttcaacaagcagtttgccgtccggtttcaaccactgcgcgcaatgactgatgaggctttgcgcatcagcagcgctaaagacattcagttccccaaacgtcatcataatgaaatcaaagggttccgtggggtggtatgtacgaatatcctgctgaatgtagtcaatattcaggtttgcggcttgcgcctgctggcgagcccatgtgatggatgccggagagaaatctacgcctgtgcagtgaaacccacgctctgctaacaggcgggtataaaaaccggggccacagccgagatccagaatgcgggcgcctgcgggtaactgacgggtaatccatgttacctgttgctcaatcacggttagccggcggctggcccagtcgtgatcctgtgacagatgattttccagcatgcgttggctgaaggctggctcgtcccaggggattttgccttcatcgggtaatagccgaatgcgatgcgttgcaaaaataacggcgctgatatccatcatcatctccttagcgattgtcaggctgggcgcgaacgttgttcagcccggttgtattaatgcggtagggctgaccgttaacggatttgatcagctttttggttttgagttttttgaatacagcgagcgtgcaatcggcgagcaacaacccttcgcggctatagcactcaacggcggtgacgcggcctgacgcatcgcggatgtgcgtaatgcgtccgcctttggcgagaacgtgtaaggtacgttgttcctgacgggataaattcatactgaagaacctgtttaatcatcataggcaaaacgtgcaaacacactgcggtgtccgcattcgatttcggcgcattgataatcagtccggcctgaaaaggtcgggtaactgattatcagatgatgacattctccagcatcaaagcctcgggttgagttgaaaggtatttacgtagtgaatgataacacctgatttctgtaagtgaataaccgggagtgaaaagtgtgatctcaaagggaggctcatgacgtttagcgtatcagatgaatagctcccgcaattaccataatgaatattgattaaactcatatacccgataatggccgctttgatagtctcgacgtatcttttggccgttgacagggttgtagcgttggaaatctttttttaacccgctgaaaaatatcacttaaatatttttcatacacaaacatttatggtccgctgagttcggatccggttttgtatgggttaaaaaaggtacgttatgaaagtcatatggactgtcactcctgtggggtatcagcgcatagcgaaacgttgcccttcatgcagcgtaaaacgggacttcacgccttctggggcatttcgggttaattcgcaaaagaaggtactcgatgtctggagtatctataaatgcacacactgcgattacacctggaatatctccctgttctcgcgcctgccagtcagcaaaattaaccgcaatctttattgccggctgatggcgaatgatgctgccacggtgcaatattttgcttatgacaacgcgatcctgaagcgaaacaatgctgaattatcggggcagcctgattttcacattcaggaacggtggctggtcagtatcgcctcccacaagcaggtcagtgttagcgtcaggatttcccgttcttttcaggtcagcctgctgtcgattttgaagaagcaactcctgctaagcgcagccgaaatcaagagacggattgaaacagggcaaataagtggcgtcacgatgaaaatgcttaaatcgcgaaaactgaagaatgcgaaatatgatttgcagctctctgttgaaacactgtatgaccggcgaaggattgttctgacccgtcgataaaaacaataagctcaccttacgtttaagtgtgctggtatggcaacgacgcaacagaatgaaagaaggactaagggacaggtgagctttagttgaataacgcttgtctgtggcattcagtgaagactgaatcgccacggataatccagacgttttcgcaccagtgatgatcagcagaatgacaaagggcgatgggttacaattatctttatctgtagagtaaataaatattcacgcaacaccattaaaaaataagaagaaatggctcactgttgagctgatattaatacctgaaccactgaattagagtaatgtggcgctattcatagcgtaattttttctgttgcggttacagggggaggaatgcacacctttagaccatacttactaaggcatagcgatctgttatatgaagatattccgttagaaatacgcgagcaaataatcttattgattattaatacattagggaattgctcctctttttatgatatgacattatactgctatcataatagtcattctgacgaagtttatcgaagaatatgtaaaacgttgcgcaaagagtatggcttattcaccttatatgcgcattcaacgtcatatctggatgaaatgagtaatctgttattaaaaacagatgataaaagaaagcatattgataccattgagcttgcttttaactatatagatacctaccttcggacctacgaagttacgcttgggttagaaccagataaggcgattagtgaattaaataatatatttcatgagcatagtttaaaatatcgatatgaaaatggtagaattgtaaggttgcgcagaataaaacggcttaaaaacatatgttattatttgtactctcctggagagtatggctttgtcgaatatgatcttatggaagcgtataatcgcctgatgcttaatgattttgcctgtgtcgtaagggaatgtcatgcagtcttcagaagcgttctcctcagaattcatgagagaaaaagtatcgtatatcatgaacaagatagtttaaatacactaatggctaatctgatggcgagaggcgttatatctgctgaatatgtacataaatttcattttttaattgacgtgctggagtcagaaatatttctgccgatggcgccagaaaagtcgcatcatcaccacgcaatgatgctccgtatctctgaagagttggcctgtagtatttattatcttactgagcggagtatattttttcttacccagcgggctgaagaggatggtgtcgcgccataatcataataatgatcgcgctgtcgctcagtcagattggatcatcgttatttaaatttgttcagacgtcggaattttttgttctgccgtctgtttttttagtgatgagctgttcagtgcaataataaggggtacagtacgatgactgatttttaaaccgcatatcatctgtgtcgcatttactcatgggtattgggtcagggagagagaagaatgagtactattttaaagccttttttatcggcggtaaccctgatgttaatcttaataaggcctggctttgcaacggaggatggagcgataaccatggttaaaacctacagcgcttatgactatttgcagacccgagcgcggttgatgcacgctgtcgccgatcacggtctggtgttatttggggaatttgaccatgccagagcggcacagaatgttaacctgaaaatgccgccgacaacggttctggtctttggcaatcctaaaggcggaacgcctctcatgctggcgcatcccgaactggcgctggatttaccgtttcgggtgctcattagccagcaagccgatgggcgaacgttagtcagttatcaccccgctgaaacgctgcaacgttatggtcttgatgccgcagacatacaggctttgaaaaaactggaacagctcgttgaaaaaagtctccactaaagctgaaaatcaggcttcaatcgggcgatgtgtttgcacaagtgatgtcgcgaataaatgcgctcacatcgtccattacctgatgagataaggcggcatcgaaggtggcgctatcagcatcacagaacccgtgccgcgcatcgtacattttacactgcacccgggggcgcttttccagcgtctgtcgcatggcgcggggatcaaacgccggctcataacgcgcgataataaccagtgccggacagagaggcgcaagatgaaggtactggcgtatacgggaaccgtaatagcaaatgacgccatcgcataacccactggctgcacttagccatgcgagcgttgcgccgacgctatatcctacgacgattaacgtctcgtactgcgctctgagatcgtggagtaacgtggtaacgacggcgggatcaaagccgacatttgctgaaaagtgacggtaagcctcctcctgctgttcatagcgaaagggggtatggtgaggaaacagcgcgggaatatagatgtcgaatccgcgcgtcatccattcatggcctgcgcgttggatatgagcgttaataccataaatttcatgcagaataatcgctgcccggcgatggcggctcgacaaactggaggcgttgcttcccccggatacgcttggggcgaaaaacactgtgtcttttatcataacgcgttcttgatacaaagagagcggctggattttcgccgatcacgctatgtcagaggcgttgttcctgtcaatgtacagacacattttatggcgtaatttttggttgataaattttatattggtaaaccaatatgttgttcatattcaggcatcagggctaaaggtggaacatcagtcgtgtattgtctactgcctttcctttcatctggcttcactaacgaaacggggcgcattattgttttgttggttgaccagtttcgcgtttttggtgtgctacgcgtgctatccctctttacaaatgctatagtctgataccgggaaatcgcatcggacgggcacgaccaatatgaaatcaaacacttctcagcaaagaccttaccaggaagtgggcgcaatgatacgggatctgattgtgcagacgccgtaccgccccggggagcgcttgccgccggaaagagagatcgctgagaggctcaatgtgacgcgtaccgtcgtgcgtgaagcgctgatcatgctggaaattaaaggtctggttgaagtccgccgcggcgccgggatctacgtgctcgacagcgcggataataacgagatggaaggcgctgacgtcaatcactgtaatgacgccgggccgtttgaactgttacaggcgcgtcagttgctggaaagtaatatcgctgaatttgccgctctgcaggccacccgcgaggacatcattaaaatgcgccaggcgttacaactggaagagcgagaactcgcctccagcgcgccgggcggctcagaaagcggcgatatgcagtttcatctggccattgccgaagcgacccataacagtatgttggtcgagctcttccgtcagtcctggcaatggcgtgaaaataatccgatgtggctccagcttcatagccatctgggcgatacgctttaccgtaaggagtggctgggcgatcataagcagatcctcgcggcgttaattaagaaagacgcccgcgcagcgaagctggcgatgtggcagcacctggaaaacgtgaagcagcgtctgctggagttttccaatgttgatgacatctactttgatggctatctgtttgagtcatggccgctggacaacgttgatgcctgattatacctggaatagcgtgggcagacccagtccacgttttacttcctgtagcgtcttttgagtgacctcatgcgcccgctcgctaccttttttcagtaattccattagcattcccttatctgcaataaaggttgcccgtcgttcgcgtattggcgcgatcagttcttgcaggcaggtctccagctcatttttacagacacgatcgcctaatccgccttgttgataatgtgctttcatcgccgcgactttggctttatccggatggaacgcatccagccacgtaaagacgacgttaccttctatttttcccggatcgctaatttttaaatgattgggatcggtgtacatcgcgctgaccgcacggtggatggtttcttcgctggcggaaagaagcagggtattgacgagcgatttcgacatcttggcgctgccgtcaatgcctggcagacggcccgtatcgctcaggagcgcctgacagggtcgcaataccggcgaggagaaaagactattcatcttatgaacgatctcattcgtttgctcaatcatgggcaattggtcgtcgccaaccggtaccatttcggccttaaaggcggtgatatctgccgcctggctaatgggatacgccatgaacccgaccggcagggaacgggtaaagcctttttgggcaatctcattttttaccgtaggattacgctccactcgggcgacggtaacaatattcatatacagcaccgttaattcagcgagggcgggtaatgcggattgcaggcagatcgtcgttagcgcgggatcgatgccgacggccagatagtcagctaacacttgcggaatattatcgcggattttttgcggattactgccgttatcggtgagtccctgcaggtcagcaatcaggacatactgttggtgatcctgctgtagcgcgacgcgctggcgcagtgaaccgacataatggccgaggtgcagcgagccggtggggcgatcgccagtcagaatgataggaagggtgttcattaaggactcctttatgcttactgtaaagccgaaagacgtcccgaaacgcagtagccgcctttcggcggctacttaaaaagggatagtgatccgtgccgccttcaggaaggcagccaccagcggagatgacgttgcgtagcgttggatcgtttcgtgttcatgtggtctaacgtatcacgactaaacgtaagggtaaagcggctggcgtgtcgtccgggcataaagtcatatcgcctgcacagagaacatgtcactgactttgaaacgcgattttataatttgctgcccaaaaatacgtggcgctgaaaggcgcatttttgatgcaagtcatttattactgtgataacactgcgcgcgataaaaacattaaatatatttacatagtaaatatgttctattggaatggttgttttcgatatgacaaaagtctaaaaaacccattgatgtgaaaaggaataagaattgtctacattccgattctgtggaattaagtaatttctcggataaaaataagaaatgatattgatatttcttttttgatatggttcttatagcggctatggttattcaggaaacgatgcttgaatgccaggcgtaatagatttcaggtcagtagcgctattgtaaaatggattgttgatggcagaaggtatttagcaagaatccagttatagcagattgtcggtatttaatctggtatacagagacaccaacgaaatggctggaaaatggaacgttctttcattgttggcgttccgtccttgtcagcctgctttgccgcatgataatcacggaggggggatggacgccatctatttaaaactggacggtattgaaggcgaaagccagatcaaaggttttgaaaaccaaataaaacttattgcttacaaccacaacccgacgaaacgggagtccggcgaagcgagagggacatatattggagggttgacgctgacaaagccagtcgatcttgctacgcttggcctctatgagcactattgtaacgggaaaacggtgaaagaaggcgtgctgacattatgccgtagtgataagggcgcaatgctgccatttattatttatacgctcaccaatgtgcgaatttcacgcatgagcaatcatggcgacgccgaaggcagcgccacggagaccgtggatttggtttatagccatattcgctgggatattcccgcattggcgtcgaaaagcaaaacacggcggccccttcaccgacaggcgctgtggcgatgaggacaaaacaagcttgcggactcgcagtgggcgatgctgtatagcgaaatggcatttagcggcttgcgaaggctgatgagcgctcatgtaaccaatcgattgcctgaaaaggcgataacgcatggcccttacacccgttatgatttttacgcatagccgctaataaaacggcattttttatatacacatcaagttgatagtgtgtttctgaccttgacgtaaataagcgggaaaagcgatgaaacacaccattgggatactgggggggatgggacctgcggcaacggcggatatgttggaaaaatttgttgaattgcgacatgtcagttgtgatcaacaacacatcccgctcattgtcagctctatccctgatattcccgatcgtacagcatgtctgttatccggcgggccttcgccataccgttatctggagcgttatctgcatatgctggaagacgccggggcggagtgtatcgttatcccatgcaacactgcgcattattggtttgatgatttacagaacgtcgcgaaagcgcgaatgatcagcatcctggacgccaccctgggggatattccgccatcggcgcggcacgttggtctgctggcgaccaatgcgacgctggcaaccgggttatatcaaaagaaagcgctggcgcgggggctgacgttaattcagccagaagacgcggggcaggcgttggtaatgcaggctatttatacgcttaaacgtggcgataaaactgcggcgcaagcgctgctgctgccgcaaatcgatagccttattgcccgtggcgctcaggcaattattatggggtgtaccgaaattccgcttattgtggccggacatgaacgcgcgatagcgtgcccgatgattgattccacagcgtcgctggtgcgcgcggcgattcgttggtatgagtcctggccagacacccgcgcctctttgaccggggaacaacgccttaccgcctgatgtgtttacagcgcggcctgaagcccacgcaggtcgcgccaaaatgtttcggctacctgactcatgcgggtattcatgcgataagcataagcctggatcgggataaccagttcgtcggcatcaagcactatcaggcgcccgtcggtaatctcctgacggatagcatactcgggtaaccaggcgattccgcagccgtccatcgcaacctgttttaacaattcactcatcgaagagacgaaaaatgtactgaaactcagttcagcatggcgagtcagggtacgatttatcagccggcccatataggagttttgactgtaattaagcaggggaaagtgcggctgctcaagcgtatagcgcggctcgccccggccattgttggcgcaaaccggaaacagtctcgactcaaacaggcggatattatcaaacggcgcttgttgcaggttttcatcgtgataggaaaaaataaaatcgctttgcccctcacgtaacatatccaccgcctggtcgacatctatcgcctcaacggcgtaggtaaactgcgtcggcatctgcttaacgatggtcggtaacaggccgagggagagcgagtgggcggcggcaatcttgattttacgcagcgtataatcgctgccgccgcgcagttcggtcagattactttccagctgctgtaacaggtggcgaacctgggagtgaaagattttaccctgttcggaaagctgtagcggcgagacctgtcggttaaacagttcaacgcccacggcatgttccagggcgcgaatccgccggctaaaagcgggttgcgatacgttgcggataatggcggcctgagagaaattgcggcacttttccagcgtcagaaaatcatatagccattttgtctcaatattgtgcaaacctgctccagttacatccatttaccgttatcctgtcagccgtccgaaggggcattctacgtccattcgggcggctgacaaccacttatcccgtcctctttcagaatgccgtgatggggcagtctgaaactagcgggaattacgccggttcaaaggtaccttttacgcaggctttcccctcattgaccatgcgtttgccgcgcgcatacacctgctcaatgcgtaaatctgcgctaaagacgagcagatccgcatcgttaccgggacggatttcgcctttgccgtccagactgaggaaggcggctacgctggttgtcagcggacgcagagcatcggtcaggctgaatccgtagtggttaaccagcgtctgcaacgtctccagcaaactttcgaagcccgcgacgccgatacccgtcagatttccggcagcgtcaaatagcggctggctgccgttgccgtctgaactgagcgtcacccgggaaagcgggacgccggcttttaccgctctggcaatgccctccgccggcgcgacgggatccgggatactggtggtaatgtcgatcacgccgcctttaagcgcaaacgccagcgcctgctcgaaaagcgattcgctacggttgacgtgggtaggcagcagtttaccgatcggcacgtcgctgttttccaggatgtcatacagcggctgtaacccttttttgctgctgcccatatgaaaaacgctgacaccgggtttgccgcccagcaggccgccaacgcgtgattcggctgccatgctggtgagttgattcccgccgggcgcggcggaacggtggtcggagactgcgcatttcacgccaatgacgcgatcgatcagcgcgacgtctttttctaccgagccagtaatggtcggcgacggaacgtgataagcgcccgtgagcatccaggcggtgatcccctcctcatttagcgctcgcgttttggctaacagcgacgcgggatgacggctgacggagtcggtgccaagcaggccgacgaccgttgttatcccggcttccgtcaggcggctcagagagacttccggcgtccgcgtcgtcggccccgcttcgccgccgccgccgatcagatgaacgtgttggtcgataaagcccgggcacagcatacgaccgctaagattaatcaccgcacagtccggtacgatatcgccggggatgtcagcgccgacggcaataattttgccattcgcgagcagaacatcgcagatgccccggtcttctggcgcaaacaggtgcgcaccctgtaacaaggtaaactccgcggcggataaatcaggcatgataactccttattaaacaataagctgcatgacccagatcgacagcagcgcattgatggcgcagactgcgataatatgcgggtaatatttggcgttgacttcggcagtaccgagacagcggccgacattctgtaccgggtttcccatcaggtaaatggctggcagtagtacggtaacatcgtggccgcttagcgcgccggcggtagccagactggccgccacgccaacggcgccgcccatactcatcagcgaagccagaagcaccgtagccgcttcgccgggaagcccccacaacgccatcacgggctggcagatatggcctacccagtcgagcagaccggtaattttcagcgcctgaataatgacaaatgccatgaccacattgggtaacaggttggtcgtggcgatggtaaaaccgcggcgtgcgccatcgataaacatatccatgacattcttacgtacctgagtcgtcatgattgggctccttgcgcagggtgacggcgttcttcgatgttaatccagatgcgcaaaaggtttgcgccgataaatttgaatagcagaatgaccaccagcggaatgatgactgacgttcccagaaaggcgaataccgcaacgccggaggagaaatagttggtgataatagcgctgccgctggtctgccaggcggcaaaaatcactttatcgcgttcggtgatttcgccttcctgcgccagctctttggtcatacccgccgcggcgtcggtattttgcaggttggcgatcagcgccagtgagcaaatgccgggaatgccaagcaatggtttcaggatgggcgtcatcaattgctgtgccgcccgcagaccgccaagcccatccgtaatcgcgatgatacccagagaaaggataaccgacggcgccagctccagcgcaaaaaggaagccatctttcgcgcccgttccgcccgcgccgcgaaaggtctgcgtaccggtcacatgaccgaatgacccgttgagtacggtaaaatcaaaaacgcgccaccagccttcgcttccggaaaatacgccggaaaagaaaataatggtgagaaaaaacgccaggtatccctttatcccgaccttttctgtatcaagcggcatggccgccccgtccacttgttgcgccatagcgatccccgaatttttttgatgatgtgttggttgtagccacaggccaaaaagcccgaaacagaaagaccttatcagccataagggtaaggacaaaatgcaagtatgtatcgtgctatgcgtttcttgcatagcagcgcgaaaaatcaccatcctcgctactgccggaggcgcggggaaccgtggacggtataacgcgcggtaaaaaagcaaagaaacaggtgttgacgcaggccagagccgggagcaggaaaaaggggaaataaatttgacgttagtcaatttcacgccttaagaggaattgtcacggtcaggtcagtagccgctgatgggtcagcttgcgccctaagaatcctacgggcaggtaataaaaaacgaataatcgaattaatttcatgatgtgatttatttataattgtgatgatttgagagggagcgataatcatcataatggaatatatagccaaaataattcgagttgcgtaaaggcggcaagggagtgagtccccaggagcataataacgatgtgactggggtgagcaacggcccgtcagggcgaggcccatggatgggccgggtaatccgtagccaacacataagccacttgaagtaggaagggtatataaaataatagacagattgataacactaaaaaccatagaataagtatagtttttagtggcatctttaccttgaaataacgtgttgaggatgtgctattaaaaacagatccgcattgcgccgcgaatagcattaaagatacaacccggtgcggatagcgcgggtttactctaccgcttattcacgtatcacaaaccgtttttgttttatctgctgcgcggtgctgatcagcgcggcaaaaaagagcgccgcggcgccgcaaagcgtggcgttgataattgccgacgcgccattgcctgacagactggcggcgagcggaccgagaatttgcccaataccatacgttagcgtcaccaggcctaacaaattaatattgcccggcgcgctgagctggcgggcaagcggcatcaccagtgaggttgtgcccataaacgtggcgccaaaaccaatactgctcagtattaacagcaacaacgagtcgctggcgagagacagcagcacgcaggcgctctggatcaacaggttcgcggtcagacatggcaggacgccccaatgttttgccgcccacagccagccgaagcagccgggaatgatcgccaggccgaccaacgaccaaaggtgtgccgtgagtagcggagagcccgcgcttttcgccatcagcggcaaataggtagcgacaatgatgtagccgaatccggcgaaaccgtataacagcgccagttgccaccaggacataggctgattttcgattcttgctaagggcgcaggcggcagcgcatgagcgcgggggggaatcaacattgccacgattaatagcaatataccggcgagcgctccggcccccagccatagcgaatgggccgaaagcgcataatgtaaaccgccaatgacatattcgttgcccagtgcaatcccggccccgacgccggaaaagagcgcggcgatcacaaacggatggcgggtatgatgcaacacaatcattgatccaaaaatcatcattcccgcactcgcgacgcctgccaggaagcgcaccaacatgacgaccgcgggctgagtaaatatcgccatagacagaataagaataccggtggcgaccgccgaagccagcagcatggggcgtagacgagaggggagatgaaaaaggccaaaggaaaacagtaagcttcccgccaggtaccctgcataattggcgctggcaatccaggagagttggttaaacgttagctgcttttccgccagcattaccggcagcatgggcgtatacagaaagcggccaactcccatccccagcgtcaataccatcataccgaaaagcgccgtaaaaatgggatggcgaggtgaagcgctctgagcatgaaccatggtttttctctttgctaaagtaaggcaggaatgccggattgtcgttgtaaatgataataaaaagtaaaattaatgtttcaaatttgcaagaaaagaaagtgaagcgcaggcgaataacggattgagaagaggggcatcggtgggaaatggcattaaattaatgcctcccacgtgcggggtttggcagttaatctgaatgagaattgcgccttccccttcttagatactgagcagtgccggtatttgcgacagtaaatataacaccagaccaatagcgccgccgaccagcgtgccgttcacgcggataaactgcaaatctttaccgatattaagctcaatctgctgcgacatatcgcgcgcatcccagccttttacggtatcgctgatgtggcgcgtcaggaaggcggcgaattccggcgcgacgcggtgcgcggcctgttccagatgaccgttaagcgaggcgcgtaatgcgtcgtcggcgatcagcgtctcgccaaaccattgtccggcatgagcgatgcgctgcttcacctttgagtcttcggcgttgatatctgtttttaaccactggcgcagatccgcccagatctcgccgagatagcggttaaacgcctcatcttccttcagataacttttaatattttctgcccgggcagccatttccggatcatgtttaagcttatcgatcagcttatacgtcgcacgatcgaaggcatgacgaatctgatgtgcgcggtcgtgactgatatcatccagcagagaattcaccgcgtcggagaccagttcagcgctgtgttctcccagccattcggtcggcagaatcttcgcttttaacggatgctcggtttccagccagcgtatgatctgtctggcgataaatgttcgggagctgtcacgttgtaacagggcgataagctgggcgatcagcgtatcgagtaacacctggtgacgatcgtttttggtcatgctttccagcatcagggcgctggtgccggaaagatccactttatcaatcgccttatgtaccgctcgcttgagcagccgctgaatacgggcgtcatcggttagttccagaaagccgctcataatttgcagcagatgctgcccgacccggctggcgttgtccggctggctgaaccagtttccaataagcagcgcgggttcatggcggcggattagcgcgatcagcgactgcgtatcaaggaacttctcctgtacaaattgcccaagattttcgccgattcggtctttgttacggggaataatcgccgtatgtcgtgaaataaacggaatgggaatgcggcgaaacagcgccaccacggcaaaccagtccgccagcgcgccaaccatcgccgcttcggcaatagcttttacgctcagcacccaaaaactgggcggcaggaaaagcgtggtcacaaacgtcgcggcggctatcagcaacagtgagagcgccaggcgtttggcgcgtttgagttcggcgattttattcatagggttaaggatagagccagacggcaggaacgtgcaaaaaatatcagatgatcctgtgccggataagcctctatccggcagagtgtttacttctcagcggccagttctgccgcctcatgctggcgcacgcgctgtaataatgtcgccagggtgaagaccacaatcaccccggccaccgctgccagcaggtgaaacggcagtctcccgccgtgaaaccacagccagcggccaacttcgaccgacaccgccatcaccgtcagaatcaccatgttcagcgaggccgaaaccgtcccttttggcaagttgttggagaaaagcgtgaagcgaaacagcgtcgggaaaatcattccaatgccgaacgcgtacaggctggtgcccagcacagaccaaagccagacgtgcggcagaagaagattaccgagaagcaatgtcgccagcccgcttaactggattggtacggcgcgccagataaaacgcggtcgggttggatctttcaccaggcgcacaacgatcatattggccacgatcaccgcgccgaatactggcacctgcgcccaggcgaattgcgaagtactcatcccgccggcatcgatcaggatcaccggcgacaccgccacccagctcatcatcgggatgtagctcaacgacagcgtcgccgccccggtgagaaaaatcgggttgcgaaacacattacgaaaatcgcgcagtacgctcaccgcgctgaacggcaccgcgccgcgttgcaccgtttctggcatcgccagcagcaggccgcacaacgccaacagtcccatcaccgcaataataccgaacagtaccttccagtgaacgaagtgcatcagcgcggcgccggagagcgggccgataaccggagcgaccagcacaatggaggtaataatcgccatcagcttaatggctttggtttgaccgaaagcctcctgtaccgtgacgtagccgaccgttgcgataaagcaaatgctggtgccctgcacaaaacgggcaaccagaaactgcgtcattgaggtcgtcaacagcgtagccgcgcaggcgagagtaaaaattaatgcgcctgcaatcagcactggccggcggccaatcctgtcggatagcggccccagaagccattgcaacgccattcctcccgccagatagagactgaccgaggccggcgcaagactgacgtcagcattaaaatcgcgcacgacgttaatgatgccaggctgaatcagatccgtcgtcagataggcggcaaaatcgtacaaaatcagcgccatcgggaaaaataacgttgtggcgcgttgggagaaaaactgaataatccgttgcataaaaaatgcgctccatgtcggagaaccccatgatgggacagcgaaactcaataccgtcatcgtgacgtcaggcaggcgatggaaacagcggctgcggatgtactgaatttcatgtaatcaaaaacgctgccggtgaaaacacagacaggaagagacgcgttctgaatctcgtcagaacgtgtggcgattacagataacaatcagcacatcacacctcgggaaatttacgttgcacggaaaatatacacattaagtgtaattaaattttgatgttaatcaaaagagtttgtctggttaataaagataaaggcagggcgcgcaggctggtattttgcgtgttcagttccgaaaatgcatgtgcattacagataacaggatttatctttcgtcgcgcctcgcaatgctgaaaaggtacggatgagaaaggaattttcaggaggtagagtcgcagcatcctggttttgggtgacggagcgccatgaaaaaatcgacgacctcaacaccgcatgatgcggtgtttaaaacctttttgcgccacccggaaaccgcccgcgattttatggagattcatctgccggtgtcgttacgccagctttgcgatctgcggacgctaaagctggagcccggcagctttattgaaaaaaatctgcgagcctattattccgatgtgctttggtcgctgaaaacgcgcgagggcgacggttatatctatgtcgtgattgaacatcagagcacgccggatgcgcatatggcgtttcggctgatgcggtatgcgatggcggcaatacaacagcatctggatgcggggcataagcatcttccgctggtggtgccgatgctgttttatcacggtgttgatagcccgtatcctttttcgctgtgctggctggatgagtttgcgaacccggaagtggcaagaagactctatgccgctgcctttccgctggtcgacattacggtggtatcggatgatgacattatgcagcaccgccgcattgcgctgctggagctcatccaaaaacatatccgccagcgcgacctgctgggactggttgaacggattgcttcgctgttagttactggttgcgctaatgacaggcagcttaaagcgctgtttaattatcttatgattcagcacggacatacgcctcgtttcaccacgtttattcgtgatgtggtagggcatgtcccgcacactaaggagagactgatgacgctgatagagaggatccgcgcagcggatcgcagaaaaggggaacggcaaggaagacagctcggtctggaggaaggattagcagaaggattagaaaaagggctggaaaaaggtcagcatgttgccgcattgcgtatcgccagacagatgctggcggacggacttgaccgcgagactgtccagcggttcaccggccttacggctgaagagcttcaggatgttagtcactaacgcggctccagtctgaatgttgcaggcccggtgcccaccgggcaacgcgctctataattatcgttgataaccgtacgaatataccgaactttaccgatagcgccagccatctctactacccttattgttctgagcggcatttccggctgccttaatgacgataacaaggagacatgtgatatggcttaccagacagtgaatcctgccaataatcagctcattaaagagtatcccccgcacacggacgcggatattgaagccgcgctgcaaaaagctgacgcgctctatcactccgactggtccaggggagagattgaccaacgtttgccggtactgcataagctggctgacttgatcgacagccgtgttgaagaactggcaaaaatcgccagccaggagatgggcaagctcatcgagcaaagccgtggcgaagtcaaactctgtgcgcagatcgctcgctattatgcggataacgcgaagcagtttcttgtcccggtgccttataaaaccgagtttggcgacgcgtgggtagaacatcatccgattggcgtcatcatggctgttgagccgtggaacttcccgtactatcagttgatgcgtgtgctggcgccgaacctggccgctggtaacccggtgctggcgaaacatgccagcatcgtaccgcactgcgccgagacatttgcccatctggtgcgtgaagccggcgcgccggatggcgcatggaccaacctgtttatttcctccgatcaggtggcgaatatcatcgccgacccgcgcgtgcagggcgcggcgctgaccggatctgaaaaagcggggagcgccgtggcggcacaggcggcgaagcacattaaaaaatcgacgctggaactgggcgggaacgatgtgttcgtcgtgctggacaatgccgatcttgagaaagcggtgaaaattggcgtgcaggcacggctcactaatgcggggcaggtatgtacggcggcgaagcgctttatcctgcatgagaaaatcgccgatcaattcctcagccagttcaccgaggcgttcaggaaggtgaaggtgggggatcagatggacgcttctaccgaactggggccgctgtcgtcgaaagatgcgctggaaacattgaccagacaggtcgaggaagcggtgaaaaatggcgcgacgctgcacgttggcggcaagccgctggaaagcaaaggcaacttctttgagccgaccattctgacccacattacgcgtgacaacccggcgtactttgaagagttcttcggcccggtggcgcagatgtatgtggtgaaagacgatgatgaggcggtaaaactcgccaacgattcccactacggccttggcggcgcggtgtttagtcaggatattgagcgcgctaaacgcatgtgcctcccggattgaaaccgggatggtttatatcaactggctgaccgacaccgcagcggagctgccgttcggcggcgttaagcgttcgggcttcggacgcgagctatcggatctggggattaaggagtttgtgaaccagaagctggtagtggtacgccgctaatccctgttgcccctctgaaaacgggaggggcctggcttttttgcagcgaaggacgcagatcttaaatcagaacgaaataaacgaacaaaacaccctcaatcgccctccttatttatccacgttgcactaaccgtgctttttatcccggtattgtttgtacagacattcatgatgcccgcattttctgttctatgcggaggctggtatggaattttacgagaaccgccccagacaaccattcattggctatgtgcagctcagacgggcgctaaaaaggtggtggctgcgtaagcgggcctgtcaggcgctgcgacgaatgagtgacgagcagttaagggatattgggttggaaaggaaggatgtggaatagtgaatctattcaagggcaatagtaagtaaaggattttatgatatattactatgcccttatgttatgcgtgctcactattttatatcatttatattaatatcattaatctttttctcaatgtatttttctggttttattttggttttttgctcaattgcatgatatttttccttatcaatggttatagtcattttttcttttttgttaaatatgccagggataataatcgcggctgcaattatcaataatattattattgctgcatgaattttgcctttgggaaatgcttttaatatagtacacaggattgttatacccttatgtataagataaggaaaagatagaaataaaacaaatgggtaagcaaaatttatgacatgtttcccatagtaattattatttgttgttagcgaaccaatacagaatgccatcacacaaaatagaaatattccgaagcataagaaggatataatgaaagaaccttgcataattcttttgtgcaactcttgcaaaatactatttgtgagcctttccagtttagtgttatgacaaataactaccaacatcgcaaaaaaaatctcagataaagcaagcgaaaataacgtattgaaggccatgtagctcatcagcgtttcgaaaaatatactttgctgaagatagtatggcaatagagcgttgacctccataaaaaaagtacatagaaatccaagggcgacataagcaattaagccttcatttctccaaagcgtaatgttttcttttacttttagccgcatggttttccttcactcattgatatgaattataattaaagctggcaagggttctttgccagcttattttatgcgtttacttagaacctgccatcacgctgataaacgcctgcacctgcttttgcttacgcgccgacagcttgcacgcctggcgcagcgactgcatcaactcgctttcttctggttgcggctgctgtgccgtgagcacaatacagccgttcatcaccctcacatccacctcggtaccggtggcgaaaccggcggcttccagccactggcccttcatggtgagggcgggaatgcgggtataatccggataacgactcgcataactcacggtaaggtgacggttatttgttggggatacttctggatcgcacggatctgcaatagaatggacggtagtcatgatggctattctcctggaatagtgattgtgatgagcgatatggccgtgttcccgcacggccatatcgcgctaaatacctgtatataacatcagtaaataaaagaaaagtccagctgaaaatagactgtaatgggaatgttcaggaagaaactggatatatttttgatggttatgaatgcgggggaataataaaaagcgcaccgggaaggtgcgcaggaaaataagcgtcaggcttttttacgcgaggtttttttaccaccgctggcggcgcgttcggccttgattttttccagcagggcggcggcgctgttttcaccgctgataagacttgggttttccgcacgccactgggcggtaagctcgccgcggaaggcctttgccaggattgactgggtgaggctgttgacgcggttcagggcgttgttaacctgcttttcaatggtgtcggcccaggcgaagagttgttcgacgcggcggacgatttcgtgttgttcttctaatggaggaactctgatgggataatttgctagtgcttttcctgtaaggtgtttaattgtagttcctgtaaagagctgagataagctaatgttatttgaatcatttttcaaattataaactaaccattcggggatgattttgtcttttacccgtgctcgatgtaatgctttttggaaaataacaggtatgtcctgaggttcactccatatagcacatcgaccaggttcaccaccttcacatattaaaacatcgccaagcttgagtgataattctctgcgctctatatctgaaattagtatatcttgaaggttttctaaatcaaaactaaaccagcgaacatttatatttccaagatattttgttgcagagccaaaatttttagctttatcaagcattttacctagtctgctatcaacaagttcagagtatttatgaacactccaagttgatggtaggtctggccattgccattcactacataatggatggtggtttcttttatttgaaccaattaacaacccgcttaccgcagcagctagcaccgcctgacgaaaacgtttcaggatttgtgggatttgctcaagacgtgctttggtgctgtctacctgtgccagcagcgtatcgagtttttcggcgatgattttttgttcggctataggtggtattggtactgtaagtgttgataacttttgagcattaacattttgtacagcattccctgctgacattaaagacagctgattccaatagtcactcgactctaaaaaacgttttaagtaatattctgaaaaataattaactggtttaaatcgaataaggtatgaagcaaaaacaacttggcttggagggttttgtaccaaaaaactaaacccaaccgaaccggctcgagatatcacaatatctctgtcctgtaattggtattttgaaacatcttccggggcatccatgcaataaggtacactggaccagtcaaccgctccttttgtaatatcggttgttcttaaaaattttacatcccccatagagcttgacttagttgtgtagccatattgaggcttactgcatatttctgaaagatgggttgtcacccacccctccggcaatttccccccactcattccttctcccccccaaacgcttcttccagcaactggcgctgcgcatccgcctcatcgcccgcgcccagctctcgcatcagtgcatccagctcgcccagcgcctgcaccagctcgcccatcgcttctgcggctaacacgtccggttccggcaggctgtcggcgtcgatgctgtccttatccttcagctaggagatatccagcgaatcggattttgccgtgcggatccactcgcggctgaacttgcgccagcggctggtggcctggtgctgatcggtgtttttgttctcttcgctgtcagcaacttccgtctcttcagcgttaaaactccactcaccttcggctcgtgggcttaagccgtgcggatcctcaccatagacggtttcaaacggctgcaggtattgctcagtaaacggtgtacgcttaccaaatctcggcatattggtgcgcaggtcgtacacccacacgtcatcggtacagtccttatcctgagtcggattggctaccgtacctttggtaaagaacagcacgttggttttgacgccctgggcgtaaaagatgccggtcggcagacgcaggatggtgtgcagatggcatttgtccattaaatctcgacgaatttccaatccaactcgatcaaatagtacgttatccggcaccaccactgccgcacggccgccggggcgcagggtttcgataatatgctgcataaagcaaagctgtttgttgctggtcgggtgcacgaaggtgcgggtaatgttggtgcccgcggcgctgccaaacggcgggttggtggcgacaatatcggcctgcggtaaattctcgccgtcgctgcccagcgtgttgcccagacggatggcgccgccgtggtcgaggttgccttcaatatcgtgcagcagacagttcatcagcgccagacgacgggtgccgggcaccagctcgaggccgataaacgcgcggtggatctggaaatcctgggtgtcgccatcaaggtcatccagatcgttggtctgcgacttcacgtaacggtcggcttcaatcaaaaaacctgcggtcccggcagccgggtcctgcaccacctcacgcggctgcggcttcagcagatgaataatggttttgatcagcggacgcggggtgaagtactggcccgcgccggatttggtttcgttagcgttcttctgcagcagcccttcgtacatatcgccgaagtcgtcgcgggacttgccgcgtgtaccgctgtaccagtccagcgaatccatgttgctgactaattctgttatctgtttgggttcagtgatggttgtacacacattatgaaataccgcctgcaccagttttttcttatcttcccccagatgcaccagcattttacggtaaaactgcaactgctcctggtcaatgcgcgatttcaggtcatcccagcggtagccttccggcaggtagtccgcttcctgaccggtctctttgcacattttcaaaaacagcagcgaggcgagttcattggcgtagttttgataggagacgccgccgtcgcgcaggttgtcgcacagtttccacagcttggcgaccagatcgttattgttcattgaagatcccatttgacatggcgaccaccattgtgggtcgcaaaagtgattgagcatttcagatgcctgatggcgcttcgcttatcaggcctacagggttacgtgtaggccggataaggcatcgccgccatccggcgaaaacggggatgataccctcttaagccagctcgtcccagatataatcgctgaacttatccagcacgctgtcgaggttgtcgtcaaaggtgcgctgtaacatggacttaccgccgcgacggtggaaattgccggttttgaagacgtcgtcgtcgagcaccactttctctttcagcgcctgcgctaaacggtcgagccagcttagctgctcagggctccagtcgttctcgcctttgatacgcgccagcgcgtgatcgacacgctcgtcgaacggtttgagcgcatcgcccaccgccgcacggcggatatggccgatcaggcgggcggcaatatcttcattgcgtgtttctttccacgcgctgcgcagagaggactcttcaaaatgctggcggtcaaaccactcctgcaattccaccagccctttacgggtgaggtcacgcggacgattgatcaccgcctgcagcgccgactgggcgttaggggcgtgttgcaccagcgcatcgaacgcttcgagaaagtcctgcggcgtatcgtagtcgccgtacagcgatttgacgctcaccacctcatcgtcaatatcgaggaagatcggcgcatcgcgcagggcgttgatatcggttttcagcctttcgaggcgggcgataaaaccaggaagcttattgaaaatctcggcgctccagtgcggccctttttcccgcaggcgcgaagccagaccaccaaagttaacgcccgcggcatccaggcacagttcgtccagacgacgtacttgcttatccaccgtttcgctgtggtcacggttataggtggcaagaccgataatccgctgcagcttagcgaccagctgttcatggctgtgttcggcaaaactgcggccatccgcttcaatggttttgtaggtttctgagtcggtaatttcgttgaccagcgtttgcagctccacctgcggacgcacaaccaccgggcgcatggtgtcgacgctttccagcgaactgtagatatccacgcagtcgtaaatcttaaagctggttttccctaccgacgggcacaaacgcgtggcacggcccttcatctgctcgtagagaatgcggcttttgactttgcgcaggaacacaatattacagatagacggaatatccacaccggtggtcagcagatcgacggtgaccacgatattgggcaaccgctctttgttgaaacggacgatcatgctttgcactttcttcgcgtctttatcggcatcaccggtgatcttgatgatcgcgtcgtgctcaagctgcggatactttttcttaaacgcggtacgcagttcgtcaaccaccatgtcggcatgggcgttggtgacgcagaacaccagcgttttttgttgcccgatgggatccaggtatttggtgagctcgccgcataccgcgcggttaaacgccgggatcaccaggccacggttaaagtcggcgacctcaaaatcctgatcgtcggccagcgtgtcgttgatcagctcgccctgtgggttcaggcgctccacctgttcaccctcggaaagatagaccccatcctgcgcgttgcgggtgacgatctgaatagggggatcctgatcgatcaggtaaccgtcgatcaccgccgtacggtaggtgtagcggtaaaccggttcgccgaaaatctccactgtatgcagcgctggcgtggcggtcagggcgatttttaccgcatcgaaatggtcgagaatgcgacggtaggcggaaacgtaatccagctggctgcggaactgcagctcgccctcggtttgctctttatcgagaatgtagccgcggtgtgcttcatcgacgacgatacagtcgtagcggccaactggcattggctcatcggattgcagcgtacgcttgaccagtgactgcaccgtggcgacgtgaattttggtgctgtcttccgggaatttgtcggtcaaccctttgatatcaaaaatgctgttaaaggtgtcgccgttaatgcgcgtgtcttcaaacgaccccagcgcctgttcgccaagcgagcgacggtcgaccaggaaaagaacgcgtttgaaacgctgcgactggatcaggcggaacatcagggcgatggcggtacgggttttaccggtaccggtcgccatcgccagcaggatctcttgctggccgttaacgatagccttttccaccgcgcggacggcatcctcctggtaatagcgcaggccgagttcgctcattccggggttttcagcaaaccactggttttgtttctgcgggtcgctgcccagcatatccagcagctcttccgggcgatgccattccggcagcgcttttgacatattggtggtgtgtcggacatcgcgataccagataccgcttttggtcttcatcgctgcgcggtattcgcgcccgttggtggagtagcagaaggggattttaaagcgctgtttgccgctggtgtcctgccagctgatttcatactctggcacggcgtcatgcacttcgtcgggagcgtagtgctccagcagcgtgtcgcgtaaaaatccgttatcgaagtatttactgtagcggtaagactcgttgagcttgctgaagacatcggtatttttgcgtttcgcttcaacgacggcgatgggcttcaggccaacgaacaatacgtaatcggcaaagcctgtttttcccgtttcatctgtacccgttggccattcggcaatcgctttattgacgccgggttccgggcgagcgcctttggcaaagcgcagcgttttactgtcggcctgccagcccgctttgcgcaactgggcgtcgatcaggaagcggctctcttcttcgctgagattcagcgtgcgcttgatagcctgatcggtgatctctttgtgataggccttacgttcctgttcggtttgcttcgccagttcggcatcttttgccgcaagctgtgcctccagcgcggccagacgtgctttggtctgggcttcggtttcctgctgtttgccctcaaggatggcaatgtagccgttgagcgcaaccagtctttgctgctgagcttccagttcggcctgactttgtactttctcttgcgcctgacgttccaactgttgtttcagcgtcagcacttcctggtgataaagattctcgccgtgttctggcagaacaaacatcggcaccgggaaatcgtaatctttggttaccagtcggtagtaccagacgctgaggcggaacccgagccgcaggcacatctgggcatcgtccagatcgttatgaaattcgtggacggccaggttaccgatacggcgcagcttatggaaaacagaaaggatgctgtcatcaataaacgcaatcttgcccagttcgcgtagcaggtcatgttggttttcgcagacgggtatatccagcaactggccgagatgtttcgcggtggcttcgccaaacatgcgcatttttatcagagtggtattaggatcgtccggatagttgttttccgccgcgcaggcgatggcgtaaatgaagtcgttgacgcctttgagaaagtcgaagttagatttgttcatttttatctatccggttcctgagcgagaagacgttattaccttgtgccgtaaagggaaaataacagacccatggtagacttcatattgtgtgtgatcaacgaacaatcagagagtaactgcttctttcctaatgttttcctgaagagtatcgttctccggcggggtatctaatctatatcaatagcagggatggatttatggctgttccaacatatgacaaatttattgaaccagtgttgcgttttctggccactcgacccgagggcgctttggtcagagaagtgcgtgaagctgcagccgaaatgcttgggttaaatgagcagcagcgtgcagaggtgattaccagtggacaactgacgtaccagaaccgcaccggttgggcgcacgatcgtctcaaacgcgccgggttatcgcagagcctatcccggggaaaatggtgtttaacaccagcgggaatgagctgggttgcctcgcatccgcagccgatgaccgagcaggaagtgagtcattttgcttgtgattttaacggcgtaaagctcagtaagccggcagatgcggtggcgttagatccacagccagaatcgattgaggatgatgagcttgccagaagcagcccggacgatcgcctggagcaagcgctcaatgagattcgtgaatctgttgccgaagaattgctggagaacctgcttcaggtttcgccggcgcgttttgaagtgattgtgttagatgtgttgcaccgcctgggatatggcggtcatcgcggtgatttgcagcgcgtcgggggaaccggcgatggcggcattgacggtattatctctctcgataagctcgggctggaaaaagtctacgttcaggccaaacgctggaaaggcaccgtcgggagcgctgaagtcaggggcttttatggtgcattgcctgagcaaaaagtgaaacgtggcgtctttattaccacctcaggctttacggcgcatgccagagactatgctaacaaagttgaaggtctggtgctggtggatggcgacaggctggtgcatctgatgattgataatgatattggcgtatcctcacgtttactcaagttgccaaagctcgatatggattactttgagtagtggtaacgctggaacctgattacgggtaattgagatggaccacgttgtgggcacctgtgtttcctctcgcccagaaatcacgtgactttctatggctgcgtatcagcctaaacccatgccttctgcggcctactcttctggtcaattttcttttatctcgaatacgcaaattgtgaagctatttccaacaatccaggtataatcgtaagataattgtatatacatttttgtatatacaattagggaaaacacatgccgatggagtttgaatgggatgcgaacaaggctaaaagcaacctgaggaagcacggtgtccgctttgaggatgcggtactggtgtttgacgatccccgacacctgtcacgtcaggagcgttatgagaatggagaatatcgttggcagaccctcggccttgttcatggcattgtggtcattctggttgctcatagcgttcggttcgaaagtggttttgaagttatccgtatcatcagcgctcgtaaggcagacagaaaagagaggaatcgttatgagcatggttaaacataaacgcggcaacgcatccgcgctgagtgctcagcatgaggctgaactgaaggcgctggcgaaaaaatcagatgatgagattgattacagcgacattcccgcttcggaggatggacagtggtctgaagcagtgcgtggtaagttttttcgcccgttaaaaactcaggcctcggtgcgtattgacgccgacgttatggaatggctgaaacggccaggaaaaggctaccagacgcggctgaatgccattctgcgcgaagcgatgctgcgcgagcaaaataagaaatagccagaagatgccggatggcggctgcgccttatccggcctacaaattcccgccaggccagataagcgcttaatggttacttccttaaccccgcaaacgccgctctgatctcgtcttccggcaactggatcccgataaacactagcgtgctatgcggcgtttcgtcgccccacggtctgtcccagtcggcgctgtagagacgctgcacgccctggaacagcagacggttgggttcgccgtcgatccacagcatccctttgtaacgcagcagtttatccgctgattccagcagcaggttttccatcacccgcgaaacctcgctgatatccaccgggtaatccagttccaccacaattgacgacacatcgttctgtttatcggcaataaagtggaaacgcggttggcttgccagcacgttctcttccagcataaagccgctggtattaaacaactgactcaggtcaatatcgccgtgtaccacggtgtaaaccggggcgcgggcgttgatacgcgccagccgctcgcgcagtttctcgctgtcgcctgccacgtcggttttggtcagcaggatacggtcggcgtagcctatctgcgactgggcgatggtgaactggttcatctgctcgttagcgtgcaccgcgtcgaccagcgcaatcacgccgtctaacaggtagcgttcgcataatacgtcatggtagaaaaaggtctgaataatcgggccggggtcggccatgccggtgcattcaatcaccaggcggtcgaaagcaatatcgccgcggtcgcggctgtcgagcaggtctaatagcgcatcttccagctcgttggagcgggtacagcagatgcagccgttagtcagggttttgatctgtgtggcgcgatcgccaatcagttgatcgtcaacggagacttcgccaaattcgttttcgataacggcgattttaaaaccatgttgttcgttgaggatatggcgtagtagggtggttttgccggcaccaagaaaaccggtaagtagggtaactgcaatcggggtcatagtctctccattaacaacagcgcataccgcctttgccatcgccgccgtaacgtgcttgctgacgttcgcggaagaactcttcataggtcatgtacggcttgtcgggatggttggttttcatgtgctcgacatagttgtcgtagtccggaataccaatcaacatttttgccgcctggccgagatatttttttgcctgacctaaagtatcaaacattctgccgtcctgttaatgaataaagccggatggcggcttgcgccttatccggcctacactagccggaatcgctgtgcgctacccggcatcagttttagtggtgtgaagagatcttcacgccgccttccggcacgggcacatacggggtttctttatcggtacgtttatcgctgttgcgtaccttcatccaggtggtgaaaccgtagaagataatactgtacaccaccaccaggaacagaatactcaaaccagcgttagtgtagttgttcaccacgatatggttcatattggcaatctgctgcgcggtcaggttggtgccgttggcaatcttctctttatacaggtttgccatgtagaagaaaccttccatctgtgggttggcgctgaacagtttcaggcccagtgcccaggtggtgcagatcagcagccataccgccgggattaccgtcacccagatgtacttggtgcgctgcattttgatcagtaccacggtgctcaacaccagcgccacggcggccagcatctggttagagataccgaagagcggccacaggctcttcacgccgcccagcgggtcgaccacaccctgatacagcagatagccccacaaaccgacgcagcctgcggtaccgatgatacccgcgaccagagaatcggtttttttcaggaacgggacgaagttacccagcaaatcctgcaacataaagcggccggaacgggtacccgcatccagtgcggtcaggataaacagtgcttcgaacagaataccgaagtgataccagaagcccatatccgccatcggcaggactttgtggaacacgtgcgcgatacctactgccagcgttggcgcgccgcctgcgcggttcaatactgacggttcaccgatatctttcgcagtttgcaggatttgttccggggaaatcacaaagccccaggagctgacggtcgccgctgcatgtgcagtaacgtctttcaactgcgccataatcagcggcgcgttctcgccgcccatctcgtgcaggtttggcatggtaatgcccagacctgccggcggggtgttcatcgcgaagtagagacccggttcaatgatcgaggccgccaccagcgccatcaccgcaacaaaggactccatcagcatcgcgccgtagccgataaaacgcgcatcggtctcacaggccagcagtttcggtgtggtgccggaagagatgagcgcgtggaagccagagacggcgccacaggcgatggtgatgaacaggaacgggaacagagcgcctttccacagcgggccggtaccgtcgacatactgcgtcaatgctggcattttcagttccgggttgaggatcacaatccccagcgccagaccgacgatcacgccgattttcaggaaggtagcgagatagtcgcgcggggcgaggatcagccataccggcagcagcgcggaaacaaaggcgtagccgatcagcgcgaaggtaatggtggtgtctttaaaggtcagcgccgggccccagtacgggtcgtgggcaattacgccgccgaagtaaatagacgccaccagcagcacgataccaataacggagacttcgcctacgcgtcccggacgcaggaagcgcatgtagatgcccataaacagcgcaatcggcaccgttgagcagacagtgaagacgccccacgggctttcggccagcgctttaaccacaattaatgccagcaccgcgaggatgatgatcatgattaagaagcagccgaatagcgcgatggtgcctggaacggtccccatctcttctttgatcatctcgccaagagaggcgccgttacggcgggaagagatgaacagcaccataaagtcctgcactgcgcccgcgagcactacgcccgccagcagccacagtgtccccggcagatagcccatctgcgcggccaataccggcccgaccagcggacctgcgccggcgatggcggcgaagtggtgaccaaacagcacgtagcggttagtcggcacgtagttcaggccgtcgttattgataaccgccggcgtcgcgcgcgtcgggtcgagtttcatgaccttctgggcgatgtacaggctgtagtagcggtaagccaccagatagacggaaacggaagcgaccacgatccacagggcgctcacgtgttcaccccgacgtagggcaacgaccgagaggcagaaagcaccgatgattccgagaatcacccagggtatgtgcttgaatatctttttcgtatccatagtaaaacctggttgtaagtttaattatcagccgaagctgggtggacattgagttcgtgtttgaggaggtagattgactgctatgctgagaggatcttgccagatcatcgcgcgcgtaaagttaggtaaatcagtgagtggttgtatggcggtttaagcggtcggacgtaccggtaagcggtttcgcggaggagggcgtgggctattttatgtgattgagatcacgatataaaatgggacgatccttgttgcgcggggcgtcataacgacttcactgagctaatcgtgatattaatggcgcgcatcccataaagttttccctttccaggccgaaaattctgtatctgtctagcggaaagagaaaacatgttaaagcgaattaaaattgttaccagcttactgctggtattggcgctatttggccttttacaactgacatccggcgggctgttcttcaactcgctgaagaatgacaaagaaaacttcaccgtattgcaaaccattcgtcagcagcagtctgccctgaatgcaatctgggtggaactgttgcaaacgcgtaataccctgaatcgcgcgggtatccgctggatgatggaccagagcaatattggcagcggcgcaactgtcgctgaactgatgcagggggcgaccaatacgctgaagctgaccgaaaaaaactgggcgcagtatgaggcgttaccgcgcgatccacgtcagagtgaggcggctttccttgagatcaaacgaacctatgatatctaccacgacgcgttggcggagcttattcagcttcttggcgcgggtaagattaacgagtttttgatcaaccgactcaaagctatcaggacgcttttgagaagcagtacatggcctatatgcagcaaaacgatcgtctgtacgatattgctgttgaggataacaacagttcctacaaccaggcgatgtgggtactggtcagtgtgctgattgccgttctggtggtcattatcgccgtctggttcggcatcaaactgtcgcttatcgccccgatgaatcgtctgattgaaagcattcgtcatatcgccagcggcgatctggtgaagcgtatcgacgtggaaggctccaacgaaatggggcagttggctgaaaacctgcgtcatatgcaaagtgaactgatgcgtaccgttggcgatgtacgtaacggcgcgaatgcaatctatagcggcgccagcgagattgcgatgggcaacaacgatctctcttcccgtactgagcagcaggcagcgtctctggaagagaccgccgccagtatggaacaactgaccgccaccgtgaaacagaacgccgaaaacgcccgtcaggccagccatctggcgctgagtgcgtcagagacagcgcaaaaaggcggcaaagtagtggataacgtcgtacaaacaatgcgcgatatcgcctccagttcgcagaaaatcgccgatattatcagcgtaatcgacggtattgctttccagaccaatattctggcgctgaatgcggcggtagaagcggcgcgcgcaggcgagcagggacgcgggttcgcggtggtggccggtgaagtccgtaatctggcccagcgtagcgcgcaggcggcacgggagatcaagagtctgattgaggattccgtgagccgtgttgatgtaggttcgacgctggtcgaaagcgccggtgaaaccatggatgagatcgtcaatgcagttacccgcgtgaccgacattatgggcgagattgcctcggcgtctgacgagcaaagccgtggtatcgaccaggtgggcctggcggtagcggagatggatcgcgtaacgcagcagaacgcctcgctggtggaagagtccgccgccgcggctgcggcgctggaagagcaagccagccgtctgacccaggccgtcgcggtgttccgtattcaccagcaacagcagcgtgcgcgtgaagtggcagcggtaaaaaccccggcagccgtgtcgtcaccaaaggccgctgtggccgacggcagcgataattgggaaacgttttaagggcgtagtggtgaacagtcggcctacagacgaccgtaggccggatgagatgttcacacttttgcctgatggcgtagcgcttaccaggcctatgcgccagtttattgataaagatgatgtgtaggccgggtaaggcgtagccgcacccggcatatatgacattctcttttaactctcaacattcaccactttgatctccaccatgccaatccccaatttgcgcggcgaatggcccaaaatattaccttcgttggtggagacgggagcgggcggcgcaatgactaaggtattcgcgtccgtcgggttgttgaaatgcagcgtgatagtggacacatcgtgacccagcaccagcgtctgttcttcgttgcctacgcgtaccggaatcggccgattcgcgttgtcgccgaaggctttggcggtgatcaccagatcaaactttttcggcagcggcgctttatattcgattttaacctcatcgcccaactgcgcatttgaccagcgcccccaggactccggccgggaaatgccgctaaactgcttcacctcctccggcgcgcccgccacattaaaaataaagctatcggctttataacgaatatcgttatcgacaatctttaaggtatcgacgttgcctttgtagcgctccatatcgatcatcgtgtctttaaacgccgtcttaccctgccactgcgctttatcaacatgctgtacggtttgctgcccgccaagctgtccctgcgagacgcaccagtcggtagagagcgccagcgccggcgcccatagctgcgccattttgtagcagcgatcgatccaaacgaaattatcgcgcggggcgaagtcggccaactggaaccgtagcggagcggagtattcactttccggtaacggctcgacgcgcttatccgatacgcgcagtagtaacggcaggcggaagtggctcccggaaaacgcgatcatgtttttgtcccgatcgacggtaaaatcttttatctctttcgggaaattccacaggcgaatgatatccggcttcatcgccagcactttctcttttacattcaggaacacttccgacagcgactgcccggaaaggctgctacgtcccagaccgataaaattatcgccgccgagaatatccagcaccgttgcgccgttgtccatcgtgttgcgtttgaccgccagcgtctcctgctgcggtttatcgccgcgcagaatgaaaaacagattgttgcgatcttgcttattcaggtatttccaggccgtattgttcatcgccagatggtcagaagagacgacgataacggtatctttaaaccacggtgacgctttgattttgttgataaactcggcgatgttttcctggctgcaacttacggtgctaaaggactggttgggcttgccgtcgtaatcgtagcgtttacggttgcaggtgcgtgagataaacccgtccgggtggtgagtatctacggtcagcgtaaacagcgaaaaacgctggcctgagcgggaaagcgcttcaaatttcttccatgcctcatcaagcaccgtatcgtcgtagaagccccagtcgttacgataagacgggtccgccaccaccgtttttagctcttcagcgccgtacagatgatcaaatccgtgtgatttcaggaacacgtctttcccggcaaaacgcaggttagcgccctgcacgaaatagttctggtagccggagtttttcagaatatcgccgaggcagatattctgcgggaagaagctggaaaccgacgcggacgcattgccctcaaacggcgcaaacagcggaataccacactgggaagccaccatcccggcgatggtgtaatccgttcccggcagttgcatggtatggctgaaatccagcccctcatttttcagcgcgcccaactctggcgtgagattggggaacgcgtcattatcaaaataggtccgttccaggctctcgccgtagatatagaccagattgagcttcggatgaggaatggtttttgctggttctttataataaacggcaaaatccggatcgccatcgcgcatttgtgattttaccagttcggtaatctggcgaaacgccgggctggcgtcgaccgaacccaacgccagcagtaacgccagcaggctgtaaccgacatgatgaggatggtgacggcggcggcgtagtacccatcccagcgcgccgaataccgccactaacgccagggcaatgccgattcccggcagaatatatttgccgactcccgctcccgtcagactattcgtgagcgtataaagcactgcgtcgttgatcccgtcgccggtaaaatagtcgctggcatacagggtaatattcagaatgacaaaaagtcccagcaccgtgagagtggcggcaaaccaccaagtgttacggcccgccttccaggcatatatcagcacagaggcgagaaacagagcgacagagagcaactcggacaactgacgatcctcaataaaccaggcttatcgctggcaggaaaaaatttctaacaatgtaatagcgatgtcacattgctgcaattctaataactttacacggcgctgttatttagaatgagtttagaaagttggttttttgatcggcatcacttcctgccatagcggttaataacaggaaaagacgaagagaaaagtcgggttaatgccgtgttggcgggtaaagggccaaaacacggcttttaacagggcgtcccggcgtggcgcacggtcagaaaagcgcagtcaggagaggaaattcagcccttgctgcaacaccagatcgcaagctttggttttcaccttttccgccagcggcgtactgccgatattattgaggttcaattgctggccgtccttcgtcttgagcaacccttgcaggccgttcaggtagttagtgtcctgctcctgctgtgtggtatccaaccctaacttgttcagaatctgatttttaacgttttccacgttggtagcggacgccagtttctgtttggcgcagtactgcaaaataccggcggcattattcatattatcagcactgagcgactgggcacctctgctgagcagaccggttagcgcagaaagcgacatcccgccctgctgtgcgttcgcgccctgagcgcttaactgactggcggcaataccgctggtggaaatcagtacgctggcgatcgccgcgcagcacagaacatgtttcgctgtattcatggtaatcacctgtgttatgccagctaggcgtcgtatcgccctggcgcacgttgcaatttaatactctttacccgtcactcggctgcggtaactgtcccagctaaaattaacccataaactgttgccgagacgcatacggtccatgacgcgttcgccaagcattttcgtcatctcttccatattgctgttcgtcaacatgccggtgggacgttttgacgaggaacgacgatcgacaatttgattgatgatcactttttcatagcgggattcggtctgcacgccgatctcgtcgatcaccagcagatcaacgttactcagatcgttaagcaactgctcttcgctggtttcccgattgctgaacgtgtctttcatcgctgacataatatccgctacggtgataatcagtaccgactttccgcgcagcagcagctcgttacaaatagccgcggcgagatggtttttaccggttcccggcttgccggaaaagacaaagctggcgatattgccgtcaaattcatccacgtactgtcgggctttgcttaacgcgttcatttgtccgtcgcactcaacccgatagttatcaaacgagcagttttgatgcagcggtcgaatgccggaacggttaaaggtgcgctgcattttcatcgcccgattttcccgcgccagcgctgccgcccggatctcgccctgctctttctgccaggccagcagttcttcgcccgttttaaacgccggcgtaatatgcgcaggcatcattttttgtagacgctgcatcaggtcgccaacatttttcatcgttaccccctaaaacctggtggaatatgattgtcaggttcgctgacgctattgatgtcgcgctgcggcattccgccattgctggaacggctgatttgcacgctgcgcgccagcttttgctgccactggatatggtgaaaaaccttaccttccgcctgccagtaggcgataaacgccgctagctcttctgcggtgacaggctcccgaagcgccacgccccaaagggcagcctgacgctgaaaatccgcatccggttgccaggcgggatacatggcgaattttccgcagggaatcgcaacgggggcggcttcgggttcttcgtaaaattgcgcgtctaacgccacatcgcttcccggacgtgataacttttcttcaagcgccagcagttcagccatgcgtgcaggcgtcacggcataaaaggcaggcgcattattagcgaataccgccactgcgccgcccgttgacttcgccagcacagcatgatgatcgtgtaaaaggacgtcaataccgatgacgtccgacgttaaaattctggaagacataatgtttctcaatatggaacaacaaccgagaagggcgactgtttttatagtaccacacagacctgtaagaacagcaggaggcgttccaccgatcacacgcgggggcgtttgcggtacagccataatcccggtacagagaggccaattgagagcgcgccaacaatggaagaggctttcagaaaattggtcagcagcgtaatcatcatcggttcgctatagcccagatggctaatttttactgcggaaatcatcgcggtataggcggaaatccccggaaacatcgggatcacggccgcgacggtaaacactttagggtgagcgagataccagcgtgaccactgaataccaatactgccgaccagcagcgaagccataaacgtcgaccattcgatattaaagcctgcgctcatcatcagcatacgcaagccatgacccagcgcccccagtagcgcgcaccacggaagcgcccggtggggaacattaaagaccatcgcaaacccgacggcggggatcgcagacaagatcatgtcctgcattagcgccagtaaaaagtcgattatacccatcctcgtagcccccatattgtcattgacatcactacgcccacacaggtggccagtgtcaacaggctggcgatagcccagcgcgccagcccggtattaatatgtcctttaaacatatctgcgacggaattaatcagcggaaagcccggcaccagtagcagtacgctcgccgccatggcgatagtgggcgtctggctaaaggcgggaagggtgagcatcagcccggaaatcgtggtagcgacaaaggcggtaatgcaaaaattgatctgcggatgtaaatgccgctgcgccagcatctggcggatatacatggctatcatactggcgaaaaaggtgataaccgcgccatcccagccgccattattcagcttacaaaagcaggagcaggaaagaccgaccataaacgccaccagccagcgcggataacgcagcgggcggagctggctaaagcgtttttccacgcctttgtaatccagcagacgatgttccgcgaggataacgatatgctgaacctccgtgacgacgtgcatattaatgccgcgatcctggtttttacgtgtcgatgtcagacattgtccgtctttaatggtcgtcaggacaatggcgttagaggagatcgcgctttcgacgctatctataccgagcgccaaaccgaggcgggtggaaagctcatcaaccagtgcgctttccgccccgtgctgcaataaaagcagcccgcattgaatacataaccgtgttactgctcgttgaattgattgctcttcttgcatgactcgtcctgtccgaaaagacattctatgcgccgccactatgacagaggctttctttttaacacgaagcgcaggcatgatggcgttggttaagatcaatttcttgttgataaaaacgtcaaccaccagacgcaacgcataagcttcctgagacgtgcgcttcgtcacaggcaggatatccttatgggcgacggttctcgtatgtccgtttccagaatagaggcattatgccagtctggccgctcatttttgaatcaatgatgtggtgaattttatcaactatatgcattaatggtttaaccacaatggcgtgagcagcgggtgtaaaaataggcatgacttagtgtaattcgtagatattacatgggttttatggatggtggacagtattgttgggcttttgttttaggactcagcaatatgaatgaagggcgaactcatattttaaatttattaatatgatgcgttttcgttagaattgctaatgtgcaaatttagttaatttaattgtcttgcttctggttttatgagtaactatgcgatagtgatttcatgtttttgtgctatgtggattgtagcgcaatcaatgttagatatttaaaaataaaacaaggataattaatccactcggcctatatttctttgcgatcattgttaatagtgtttttattaatggggcaatgaaaagtggcggcgtgggtgcggaggaattatgctgccaggatgctgcaaaaatggacttattatcagtaaaacccctcttatacaggaaggccttaaaggggctataacaggtaatttccccgattataaactggcgtattgtcgtacgatagaagagctaacgctgctacagctacgccgaagtaatttagttattgctgatttagcagttaacaatgcctctccccgcgctatctgcgaatatttttatagcttaatctcgcaatatcgcgacatacattgggtatttctggttcctaaatcctgctatccacatgcggttgatctcctgatgggccccgtcagcaccttgctttcagacgaagagccaatcgagaatcttattagcgttatccatgcgggaaacgctcgctcagaaagaataagtaaaacgttattatcgcctcaggtaccgtctgaaattcagcagtcccacgacaggccgattgtccttacgctgtctgaacgaaaagtattacgccttttaggaaaagggtggggcattaaccaaattgcggcgttacttaaaaaaagtaataaaacaattagcgcccaaaaaaatagcgccatgcgacgcttatcaatacacagtaatgcagagatgtatgcatggataaacagttctcagggagccagagaattgaacctaccttcggtatatggagaaaccatggaatggaaaacagaatcagcaagaaaaatgttgcgctcgtagaaaaatgcgtgatgagcaccattggtattaaagggctatttgatgcaatgccggattgccgacatacgcttcatattttttcaaaaccatccgcgttttataaggctgcgctaaagacgccgttttctgccgttattttttctctttctgcgttaagaactgaacgccggacaggattatccagcctgacggaactggcgataaattatccccatatgcggcgtctggtgattgccgatgatgatgctgaagcccgcttaatcagcgcattatccccgctgccgctggatggggtcatcagcaaagcgtcgccgttggatgttttacaggatgccttatttacatcgcttaatagcgcccggcggacaacggagcgtacagacaatctttgggaacttcaccagaattgtatgcttagtccaaccgagcgggagattctgcgtttcatgtcgaacggctactcaatgccgcaaattgccgtccagttagaacgtaacattaagactatccgggcgcataagtttaatgtgatgtccaagctgggcgtgagttctgatgccgggttactcgatgtggcggatattctgttatatctgcgcgccggagatgctaccgcgctccagcatcgggtatagcccgcgccggatgcgccgtgcttgttcggggaatccgggtgtcaggcacgttattggcacacgtctacccaggtcgccgatgtcagttcagccattctttccggcgtgatgcgtaccgcgctgtgcgtggcgcctgcggcaggcaatacttcgttataccccttcagagagatgtcgcaataaacgggcagcgggtgctccagcccgaaaggacatacgccgccgacaggatgtccggttgcattgaccacttcatcactgctcaacatacgggcttttgcgccgaaagtggttttaagcttcttattatccaggcgggcatcgcctttcgcgaccaccaggataatggtgtcttttactttaagcgagagcgtcttagctatctgccctggctctacgttgtgcgctttggctgccagttcgacagtcgctgtactttgatttaattcgataatttcaatatcgggagcatgagcggccagaaattgccgtacagattgcagactcattcttctctcctgagaccttaccaatagccacggtagacccaaaaatggcaaaacgtaatttggcatacggagagcgccgctgtaaatataataatgtgacaggccagcagcagtaagccgtgacgataactgaaggcaacgtaaagcggtttactttagcgtgcagtcgccgcactgctgtacgtcaggtaagcggtaacgttggcagcaggttctgcgtaccagaagaccgtcgcgcattacgacggtccgccacagcgggttatcctgaccgtcggatagctgcttttcaaaaaaacagcgctggcgtagcgttgccagcagggcttcgccaagcaacggtttcatctcagtcagataccagttgattaaataaccggtattgctccagataagtttcgcgttgatgtcgccagtcgcctccagcgcctgaatgaccggctgtagtgcggagactattagcgtttccattcgttcttccggggaacgttccgttgccaggttatcctgatgcacatcaagccagaaacacgcggcgcgcccggtttcatgaaattcaacgtgaatatgttctgccgagacattgatagcgcgcgcttgcgtcagtaatgccagcatcagcggcggcgtcatcagcccgatataccattgcgcccacagggagagtaacggcttattttcacgtggcaggcctggcgtgtgccgatagatgtgatcggaataggcggccagcaatgaacgaaacgtcgcggggcgcgtccactgggcaagagtcatcgccgttggcggcggcgtttcatccagccggatgaagtccaacaggtgctgacgggtagaggcgatcgtctcgcgtactgcgtccgccagcgaggcgtcttccggctggggagcagctcgccagataatatcgtcagcaatcggtgcggaacggtaggccatagcgcagtttaatgatgttaatctaaatgataatgattgctaatcctatcgatagcgataaacgatggcaagcggtttatggttaacgctgttggcgtagcacgattacgccaacaggattcatagggcgcgcatgtcgtcgctgaccagaatgtggttacgtccaagatgcttggcttcgtagagcgctttatccgctttttcgatagcgtctccgatattgcgatccgtcaagggcgcaatgccgatactgacagtgacattggtggcgacgctttcgttaaacatatgcgggattttaagatcgtatacttcctgtcggatacgttctgcggtagcgcgggcttgctgtggttcggcggtggtcagcaacaccagaaattcttccccgccaaaacgacagacgacatcgcgcgatcgcacggcgtcccgaattgccgctgagacgcggattaacgcctgatcgcccatcatatgaccgtagtgatcgttatacgctttgaaatgatcgatatccaatagcaggacgtagtgttcatggctgcccggcgcctgtaacgtatccagccgattttgcaggccacggcggttatataagccggttaatggatcaagcatactcaggccattgagggtttcccgctcggccagcagcttaaacatgagctgttgggcaaaattatcgtagcgtttctggataacatgttgaatagcgattcccaccattggcagggccagcaaatagagaattcgcaaaccttgttcattaccgttcaaccacaggcagaccgcgactggcggtagcgaatagagcgtaaacgcgacgatattcgcggcaaaggctatcgagccgataaacagaacgctaagcagggagatcagtaaaaaagagaaatcataatggcctaacgccggatactttagcgcaatacgcgccgcccatattcccccaaagagtagggagataaaggggaggttaattcttttttgcccatatttcccatgccatatcaacagtaatacgctcaggcccactatcccgatcattggcgtgcaaaatacattgatctgataaagggggaaaacgagagtaaatagcgccgacacggcgctgagaaacaagaaaagacgtaaagaaaactgatacttcttaatacgaagcgatcgccaggatggtgttgtcatgggtaattgtcgttatttatcagtgatatacacggaatcgggcgccaacatgaaaataacgtatgagaaaaggtcgcctaaagcgaggtgttgttgtttttacgttaacagtcggacaatttatcaccttactgaatacgtgtcatcaaccgttaagtaaaactcatctctttagctttctccctggctgacaaatgagaaaatatatcatatgatattggttatcattatcaattccagaggtgaaaccatgttgcagcggacgttaggcagcggatggggcgtgttattgcctggagtgattatcgttggactggcgtttatcggcctgtcagcttatgcgctgaagctgttgattgtatcaggattgctactgtctgcgctgatgttgtatcacaaacaattacggcattttgtactgctgccatcgtgtatagcgcttattggcggcatgatgttggcaatgatgaactggaatcagggatgaaaatgaagggacaaaggaaggataagataattggtgcgaggggggggacttgaacccccacgtccgtaaggacactaacacctgaagctagcgcgtctaccaattccgccaccttcgcacagttatcttactttttgatatcgcctcgttggtgcgaggggggggacttgaacccccacgtccgtaagaacactaacacctgaagctagcgcgtctaccaattccgccaccttcgcccagtgcgagcaatatcaacatggttttggtgcgaggggggggacttgaacccccacgtccgtaaggacactaacacctgaagctagcgcgtctaccaattccgccaccttcgcataccatcgattcttgaaaagaatcactaccacggaggcgcattctagtggttttcagctattcgtcaatagttaattgcatgggatagattgattgctgcaaaaatgggcgcgagacgtaggttggataagacgcctggcgtcgccatccggcacatgcaaccagatggcgctgcgcttatcaggccaactatttcttcgcctgacgggtcatcacgatacgataaaccttaaagcgcccggtttgcgcgatgacttcatggaagccaaaggtctcatccagaatcttaggatagggcagaaaggcgttcgccacgatgcgtaactctccgccgctgttcagatggcgcactgcgccgcgaatgagcgtttgcgccgcatcaaggctggtttgcattccgtcgtggaacggcgggttggagatgatcatgtcaaaacgtcctttgacttccgaaaagacgttgctggcgaatacctcgccttcaagaccattagcggcaagcgtggcgcggctggcttccaccgccggcgcgctgacgtcacacagcgtcaggcgcactttcggcgaatggctggccagcgcggcggaaagcacgccagcgccgcagccgacatccagcactttacctttggtgtgcggcgtcagcgtagacagcagcagttggctaccaacatccagtccgtcgcggctgaatacgcccggcaacgttttgatggtcagcccgtcgatattgtactcggcccaccaggattcaagactaaactgcggctgcttttccagacgaccatggtaaaggccgcaacgtcgcgcgctatctactttgttcagcggcgcatagtccgccagcatcggttcggcgctacgcacgccgctgcggttttctcccacgacgaaaacatcgctgcccaccggcatcagcgacaaaatattcatcaactggaactgcgcttcgggtttatttttcggccagtagtagatcagcgtatcgcagtcagcgacatcgctggcttgcgcgaccaggctaaaacggacgttatcgcccatctggcggcttaacgcctgccagtggtgaaactgttgcgtatacgcgcggctggcggcgcattcaaagcgcgcgggcaggtcatcctgcaaatctccggcaaaaagaatacggctttgttcgaaatcatcactgtggcgcagcaagacttcacttgccggggtaaaagcagacatggaatgctccttaattcagactggcggcgattatagtagtttgatggcggagattcgacagatttgctatatttgcgcccctgattacaggagcgtttcgctatgacatcccgacgagactggcagttacagcaactgggtattacgcagtgggcgctgcgacgtcctggcgcgctacagggcgagattgcgatttcccttcccgcgcacgttcgtctgatcgtggttgcagaggaattacccgcgctgaacgagccgctaatgcgcgatattttacgcgcgttgaccgtgagtcccgatcaggttttaccgctgacgcctgagcgcgtcgccatgctgccgcagggcagccgttgtaatagctggcggttaggaactgacgcgccgctccaactcgaaggcgctcaggtcacgacgccggcgtttaatgaactccgggtaaacccggcggcacgcgccgcactatggcaacaaatctgcgaacatgaacacgatttctatcctcagcacgaccgatctccccgcagcctggcagattgagcaacgcgctcatgcgtttccgtggagcgaaaaaacgtttttcggcaaccagggcgaacggtatctcaactttaagctgactgctgatgacagaatggccgcgtttgccattacacaggtggtgctggacgaagcgacgctgttcaatatcgccgtcgatccggattttcagcgtcgggggctggggcgtatgctgcttgagcatctgattgatgaactggaaaaacgcggtgttgtaacgttatggctggaggtacgcgcctctaacgctgccgccatcgcgctgtatgaaagtctggggtttaacgaggcgacgattcgccgcaattactatcccacggcacaagggcatgaggacgccatcatcatggcgttaccgataagcatgtaataaaagaggcaaggtgtaatgatgaagtgggactggattttctttgatgccgatgaaacgctgtttacgtttgattctttcaccggcttacagcggatgttccttgactatagcgtcacctttaccgctgaggatttccaggattaccaggccgtgaataagccgctatgggtggattatcagaacggcgcgattacttcattacaattgcagcacgcgcgctttcaaagttgggctgaacggctaaacgttgcgccggggcggctgaatgacgcttttattagtgcgatggcggagatctgttctcctttgccgggcgccgtttcgctacttaatgcgattcgcgggcaggctaaaatcggtattattactaacggttttaccgcgctacaacaaactcgtctggagcgcaccgggctgcgcgagtatttcgatctgctggtgatttccgagcaggttggcgtcgcgaagcccgatccgaaaatctttaactacgccctggagcaggcggggaatcctgaccgctcgcgcgtattaatggttagcgataccgcggagtccgatattcttggcggcattaacgccggactgtcgacctgctggcttaacgcgcatcatcgcgagcagcccgcgggtatccatccaacctggactgtggcgtcattaagcgaactggagcagctcctgtgtaaacactgattgcctcccccaggttgatgggtaaaatagccgcatttttcgtattcaacatgcgtggtcaaacgccgcgcttactcaagaagatttgactatgacgttgtctccttatttgcaagaggtggccaaacgccgcacttttgccatcatttctcacccggacgccggtaaaaccaccattaccgaaaaagtgttgctgttcggacaggcgattcagaccgccggtacggtaaaaggccgtggctccagccaacatgcaaaatctgactggatggagatggaaaaacagcgtggtatctctatcaccacctcggtgatgcagttcccgtatcacgattgtctggtgaacctgctggacaccccggggcacgaagacttctccgaagatacctaccgtaccctgacggcggtggactgctgtctgatggtgatcgacgccgcaaaaggtgttgaagacaggactcgtaagctgatggaagttacccgtctgcgtgatacgccgatcctgacctttatgaacaaactcgaccgtgacatccgcgacccgatggagctgctggatgaagtggaaaatgagctgaaaatcggctgtgcgccgatcacctggccgattggctgcggcaagctgtttaagggcgtttatcacctttataaagatgaaacttatctgtatcagaccggtaagggccacaccattcaggaagtgcgcatcgttaaagggctgaataacccggatctggacgccgccgtcggtgaagacctggcgcagcaactgcgcgacgagctggaactggtgcagggcgcatctaacgagtttgatgaagagctgttcctggcaggggaaattaccccggtatttttcggtaccgcgctgggtaactttggcgttgaccatatgctggatggtttagtggcgtgggcgcccgcgccgatgccgcgtcaaaccgatacccgcacagtggaagcctcagaagagaggttcaccggttttgtctttaaaattcaggccaatatggacccgaaacaccgcgaccgcgtggcgtttatgcgcgtggtttccggtaagtatgagaagggcatgaagctacgccaggtccgtaccggcaaagatgtggtgatttccgacgcgttaacttttatggcgggcgaccgttcgcacgttgaagaagcgtacccgggcgatattttgggtctgcataaccacggcaccattcagatcggcgataccttcacccagggcgagatgatgaagtttaccggtatcccgaactttgcgccggaactgttccgtcgtattcgcctgaaagatccgctcaagcagaagcagctactgaaagggctggtgcagctttctgaagagggggcggtgcaggtattccgtcccatctccaacaacgatctgattgtcggcgccgtgggcgttttgcagtttgacgttgttgtcgcgcgcctgaaaagcgaatacaacgttgaggcgatttatgaatccgtcaacgtggcgacggcgcgctgggtggaaagcgccgatgcgaagaaattcgaagagtttaagcgtaagaatgaaacgcagctggcgctggatggcggcgacaaccttacctatatcgcccccacgatggttaacctgaacctgacccaggaacgttaccctgacgttcagttccgtaaaacgcgcgaacactgatccctttccgggcgcggcatccgccgcgccttcgtactttccctgcctttttaaccgcttacggaatgttcttaaatcccgcgttttttctccgatctgcctgttttttatacgcaccgacaagcgattttaaaattgtgatctatatttaacaaagtgatgacataaatgtcggctttaatgcctgttcaatgcgtgaatatgagagcttaaagctgagatttgtttcagtcacgatattaataactgaaacggaagggtggcaggcgacgcgtcgttacaaattcacgaatgtgatgccagtcattgacttcagaaaccggtgagtttcaccgcattcagcaatgcaacctcgtgttgcctgagctcaaattacgagcaaactatacaggacaaaatcgatgactatgacaagactgaagatttctaaaactctgctggccgtaatgttgacctctgctgttgcgacaggttctgcctttgcagaaaacgcaacaacggacaaggcgcaaagcggaaccgaaaccgcagggcaaaaagtcgatagctctatgaataaagtcggtaacttcatggatgacagcgctatcactgcgaaagtcaaagctgcgctggtagaccatgacaatattaaaagcaccgatatttctgtcgaaaccaatcagaaagtcgtcaccctgagcggctttgtagaaagccaggcgcaggctgaagccgccgtgaaagtggcgaaaggcgtagaaggcgtgacctccgttagcgacaaacttcacgttcgcgacaataaagaaggttccgtgaaaggttatgccggcgatacggccacgaccagtgaagtcaaagccaagttgctggcggacgatctcgtcccttcccgtaaagtaaaagtggaaacgaccgatggcgtcgtacagctctccggtactgttgaaactcaggaacaaagcgaccgcgctgaaagcatcgcgaaagccgttgatggcgtaaaaagtgttaaaaacgatctgaaagttcagtaattcgtcgtaattcgtcctcccgacgtttgtcgggaggcgtaatgtgcaccacactaaaaatatcgcgaatgagtagcctgagcgctcatatttagcggtcgacattaactatggtaaaggagaggcttatgtttcgttggggcattatatttctggttatcgcgttaattgccgccgcattgggttttggtggactggctggtacggctgccggcgcggcgaaaatcgtcttcgtcgtcgggatcgtgctcttcctggtcagcctgttcatgggccgtaaacgaccctagcaggcagctgtaaagatatattgctatcaagccagtccagcggactggcttttacggttttagccgttaacgttttgcattaccttgtcagcctggaaaaaaatgaaaaacaggaaggcagaggtgggccagcgaataccggttacgctcggcaatattgcgccgttatcattaacaccgttccggtcaggccgtatggcgctggtctgtgagggcggggggcagcggggcatctttaccgcaggcgtgctggatgagtttatgcgtgcgcagtttaatcctttccatctctacttcggcacatcagccggtgcgcaaaatctctcggcgtatctctgcaaccagcccggctacgggcgtaaagtcattatgcgctataccaccaggcgcgaattttttgatccgctgcgatttgtacgcggaggaaaccttatcgacctcgactggctggtggagtccaccgccgcccggatgccgctgcagatggatacctcagcgcgcctgttcgacagcggaaaatccttttatatgtgcgcctgccggggggatgattacacgccgggctatttctcgccgacaaaacaaaactggcttgatatcattcgcgcctccagcgccataccgggtttctaccgtaccggcgttacgttagagggcatcaactatctggacggtggcattagcgacgccattccggttcaggaggcggcaaagcggggggcgaaaaccattgtggtgatccgcaccgtaccctcgcaaatgtattacacgccgcagtggtttaagcgtatggagcgctggctgggagagagcagtctacagccgttggtcaacctggtgcagcatcatgaaacgtcctacagcgcgatccaacaatttattgaaaagccgccgggtaagctgcggatcattgaaatttatccgccgaaaccgctgcacagcatggcgctgggcagccgtatcccggcgctgcgtgaggattacaaaaccgggcaattatgcgggcgttatttccttgccaccgttggtaaattgctcgccgcaacgccgcctctcttgcgccattcgtcgcggattgccgtgccggaaacggtggtcgtgcctccggcaccggtggccaatgatacgcatgtggcggaggtcattagcgcgccgcaggcaaacgacaccacatttaccgacgaggatctggcgtgagctggcgctttatcgatacgcattgccattttgatttcccgccctttacgggcgatgagcgcgccagtattcagcgtgcctgtgaggcgggcgttgaaaaaatcatcgtgccggcgaccgaggcggctcactttccccgcgtgctggcgctggcggcgcgtttcccgtcgctttatgctgcgctgggattgcaccccattgtgattgagcgtcatgccgatgacgatcctgataagctgcaacaagcgctggcgcaacaacagaacgtcgtggcggtaggcgagatcggtctcgatctttatcgcgacgatccgcagttcgccaggcaagagcgatttttagacgcgcaactgcaactggcaaaacgctacgatctgccggtgatcctgcactcgcggcgcacgcatgacaaactggcgatgcgcttaaagcgccagagtttgccgcaaaccggtgtggtgcatggtttttccggcagtctgcaacaggccgaacgttttgtgcaactgggctataaaatcggcgtcggcggcaccatcacctacccgcgcgccagtaaaacccgtgatgttatggcgcggttgccgctggacgcgctgttgctggagaccgatgcgccggatatgccgctaaaggggtttcaggggcagccgaaccgcccggagcaggcggcgcgcgtatttgatgcgctctgcgaattacgtccggagcccgcagaggtgatagccgatacgctgtatcgcaataccgttaccttgtttcggctctgatggcatcgcagccgccgtccggcaggcgacgcttacaaatatagcgccggcaaaatcagcttcgccaccccacgcgcgcgcaatccgtcagccagccgttccacctcttgcggcgtcgcgcctggccaggctttcgcttcgccatagacgccatgcgcatgaaaggcattcaggcgcaccggaacctcgcccagcgaagtaataaacgccgccagtgaatcgatatgcgccgcatagtccacctgacccgggataaccagcaaccgcagctccgccagttttccccgcgcagcaagaaagcggatactgtgcttaatatgcgtgttatcacgtccggtcagacggtgatgacactcgctcttccaggctttcagatcgagcattacgccgtcgcaaaccggcagtagtttttgccagccggtctcgcttaactgaccattactgtccaccagacaggtcagccgttgtaactgcggatcggctttgagcgccgtaaatagcgccacaataaacggtaattgcgtggtcgcctctccgccgctgacggtaataccttcaataaacagcgatgctttacgaatatgacgcagcacatcgtcaatgctcatagtctgcgccattggcgttgcctgctgtgggcacattttcaggcaggtatcgcactgctcgcagacgtccgaccgccataccactttcccgccatcaatgctgagggcgtggtgcggacactgcgatacgcattccccgcagtcgttacagcgtcccatcgtccacgggttatggcaattcttgcagcgcaaattgcagccctgtaagaataatgccaggcggctgcctggcccatcgacgcaggaaaacgcaatgatcttactgactaaagcgcatctgttgttcatggctgactacgcgtggctgtcgttccaggatgcgggtattacgtgcggcttcttctcccagccaggtggtattcgtgcgcgagccttcggcgcgaaatttcgccagatccgacaggcgcaccatataaccggtgacgcgcaccagatcgttgccgctgacattggcggtaaattcccgcatcccggctttgaacgcgccaagacaaagctgaaccagcgcctgcggattgcgcttgatggtttcgtccagcgtcagaatgtcgctgatcccggcatgataaaaggcatggtgcggcgcgacggtttgcaaatgggtgatagggtccggttcatcgccatacggcagacgcgcgcccggcgtagtgccgatatcggaactgatgccagactgggcatggagcagcgcccgttgcttcctgccatacttcactggcgtattttcgacgaaatccgccagttgggcgctaatacggtagcccagctcgttcgccgtttcattcttgccgtaacgggcggtcaggccggcgttttcgcacagcaggttcacggcttccgccagcccgtacataccgaacatcggcgcaaaacgttcgggatcgatcaaaccttcctgtacaaggaagctattctcaaagaaatgtgacttttcatagaggaattcacatcgtgaattaatgatggcgatctgctgtcggcagtagtgcggtagcgtgcgtgaaaagaagtcatcgacagacgtactgcgttctgccacggctttcaggttgagacgtaccagcgtactgccaccgccggcaagcggtagcgagttataacaactgacgatgccataatggccttttgtgaaaattttatcatttacagggccgttggaaatgtgtggcttactgcattcgcaaatgtttttggcgacctccagcagcagatcgtccggcgtaatttccgcatcgtagataaacgtcaggttaggcgccacctgctttaactcggcatcggcgcgcaaaatcgctcgtgtgacaggcgtatcggcagggccaatattggcatgcataaaggcgtctggcagcgttctgtcgagataacgccagaaacgttttattcgaatatcgatcgcatcttgtgttagaattctaacatacggttgcagcaacgcatcaagctggccgagataaaccggcatggacgtcacggaaggaacgtgatgatacagaatggtgagtagggataacgcatcatccagatctttcgcgccttccagttccagccactgtgaaccgttagccagaaatcgggcgtaatcgggcaacacgtagcgcggtttgaagggggcgtgcccctcaaacatatcgcaaatgacgccttcatccagcgcctggcgggcatcttccggcagggtgggataaggcagggcgttttcagcttccagcgccagaaaatggcgtttttgttcaggcgtgagcaccgggctggtcacaatttgctggcaacgctgctggagcgcagtttcgcatgaggcaggcatcttcgtttcctctttatgccgggacgatgcgctattgtagaaaatggcggcaaaccgactttgatcctgatgcgcttaacgctcgaagaacaggcggtgacggcgggataatttgattcagatctcattacagtaatgcaaatttgtacgtagttttcattaactgtgatgtatatcgaagtgtaatcgcgagtgaatgttagaatattaacagactcgcaaggtgaaattttatacggcaatgccgttggagaatgtcatgactgatttaaaagcaagcagcctgcgtgcgctcaaactgatggatctgaccactctgaacgatgacgacaccaatgaaaaagtgatcgcgttgtgtcatcaggcaaaaaccccggtcgggaatacggcggcgatttgtatttacccgcgttttatcccgattgcgcgtaaaactctgaaagaacaaggtaccccggacatccgcattgcaacggtgactaacttcccgcatggcaatgatgacatcgatattgcgctggcggaaacccgtgcggcgatcgcctacggcgctgacgaagtggacgtggtattcccgtaccgcgcgttgatcgccggtaacgagcaggtgggttttgacctggtaaaagcctgtaaagacgcttgtgccgcagcgaacgtattgctgaaagtgattatcgaaaccggcgagctgaaagaagaggcgctgattcgtaaagcctctgaaatctccattaaagccggtgcggatttcatcaaaacctctaccggtaaagtgccggtaaacgctacgccggaaagcgcgcgcatcatgatggaagtgatccgcgacatgggcgtttccaaaaccgttggcttcaaaccggcgggcggcgtacgtacggcggaagacgcgcagaaattcctcgcgatcgcagacgaactgtttggcgctaactgggcagattctcgtcactaccgctttggcgcatccagcctgctggcaagcctgctgaaagcgctgggtcacggcgacggtaagagcgccagcagctactaagctctgatttgccggatggcgctgcgctttccggcctacaaatccaggcctgtaggccggataaggcgttagccgccatccggcgatgtaagccttctactcttttccctcaggagggtaccgtgtttctcgcacaagaaattattcgtaaaaagcgtgatggtcatgcgttgagtgacgaagaaattcgtttctttatcaatggtattcgtgacaatactatctctgaagggcagattgccgccctggcgatgaccatcttcttccacgatatgaccatgccggagcgtgtttcgctgaccatggcgatgcgggattccggtactgtccttgactggaaaagcctgaatctcaatggcccgattgtcgataagcattcgaccggcggcgtaggggacgtgacgtctctgatgctggggccaatggtagcggcctgcggcggttatgtgccgatgatctccggtcgcggtctcggacataccggcggtacgctcgacaaactggaagcgatcccgggcttcgacatcttcccggacgacaaccgtttccgcgaaattattcaagacgtgggtgtggcgattattgggcaaaccagctcgcttgcaccggcggacaaacgtttttacgccacccgcgatattaccgcgacggtggactctattccgctgatcactggttccatcctcgccaagaaactggccgaagggctggatgcgctggtaatggacgtcaaagtcggcagtggcgcgtttatgccaacctatgaactttctgaagcccttgctgaagcgattgttggcgtggcaaacggcgcgggagttcgcactacggctttgttaaccgatatgaaccaggtgctggcttcgagcgccggtaacgcggtggaagtgcgtgaagccgtgcagttcctgaccggagaataccgcaatccgcgcttgtttgacgttaccatggcgctatgcgtggagatgctgatctccggccagctggcgaaagacgacgccgaagcgcgtgcgaaattacaggcggttctggataacggtaaagcggcagaagtctttggtcgtatggtggccgcgcagaaagggccgagcgatttcgttgagaactacgataaatacctgccgaccgccatgttgagcaaagcggtatatgctgataccgaagggtttatcagcgcaatggatacgcgtgcgctggggatggcggtcgtctcgatgggcggcggccgtcgtcaggcgtctgataccattgattacagcgttggctttaccgacatggcccgtctgggcgacagcatcgacgggcagcgcccgctggcggtgattcatgccaaagacgaagccagttggcaggaagcggcgaaggccgtcaaagcggcaattatccttgacgataaagcgccagcaagcacaccttcggtctatcgtcgaattactgaatagttgtatactgatctgatcaattatttttgaagcactaagtacggagaagatatgaaacgtgcatttattatggtgctggactcattcggcatcggcgctactgaagacgcggatcgttttggcgacgtaggttccgacactctgggccacatcgcagaagcttgcgccaaaggcgaagctgacaatggccgtaagggcccgttgaatctgcctaacctgactcgtctggggctggtgaaagcgcatgaaggctctaccggtaaaattgccgccggcatggacggcaacgcggacgttattggcgcatacgcatgggcgcacgaactgtcctccggcaaagatacgccgtccggccactgggaaatcgccggcgtgccggtgctgttcgactggggctatttcagcgaccacgaaaacagcttcccgcaggaactgctggataagctggtaaaacgcgccaacctgccgggctatctcggtaactgccactcttccggtacggtcattctggaccagctcggcgaagagcacatgaaaaccggcaagccgattttttacacctccgctgactccgtgttccagattgcctgccacgaagagacctttggcctggataaactctacgagctgtgcgaaatcgcccgtgaagagctgaccgaaggcggctacaacattggccgcgtgatcgcgcgtccgtttatcggcgacaaggccggtaacttccagcgtaccggcaaccgtcacgacctggccgtagaaccgccagcgccgaccgtgctgcagaaactggtcgatgaaaaacagggccacgtggtgtccgtcggtaagattgccgacatctacgccaactgcggcatcactaagaaagtgaaagcgaccggtctggacgcgctgttcgacgcgaccctcaaagagatgaaagaagcgggcgataaaaccatcgttttcactaacttcgttgacttcgactcttcctggggccaccgtcgcgacatcgcgggctacgccgcaggtctggagctgtttgaccgccgtctgccggagctgatggagctggtgggtgaagatgacattctgatcctgaccgctgaccacggctgtgacccgagctggaccggtactgaccatacccgtgagcacattccggtgctgatctacggtccgaaagtcaaaccgggctctttaggtcaccgtgaaacctttgcggatatcggccagacgctggcgacctactttggtacatcgccgatggactacggtaaaaacatgctgtgatacccgttgtctttcgcgctgtagatgcgttgacttcattcgctcaccccggtcacatcgttaatctatgctcccggggattcacgaattcgtcgccttcctacaacgcgaaatccttagggtatttcactgtttttacacacgttttgtaggcctgataaggcgtagccgccatcaggcaataacaacaaatttaaagggaactgaagatggcaactccacatattaatgcagaaatgggtgatttcgctgacgtcgtattgatgccgggcgacccgctgcgtgcgaagcacattgctgagactttcctcgaagatgtccgcgaagtgaacaacgttcgcggcatgttaggtttcaccgggacttacaaaggccgtaagatctccgtgatgggccacggtatgggtatcccgtcctgctccatctacaccaaagagctgatcaccgatttcggcgtgaagaaaatcattcgcgtcggctcctgcggcgctgtgcgcatggacgtcaaactgcgtgacgtggtgatcggtatgggggcctgcaccgactccaaagtgaaccgtatccgtttcaaagatcatgactttgcggctatcgctgacttcgacatggtacgtaacgcggttgacgcggcaaaagcgctgggcgtagacgcgcgcgtgggcaacctgttctccgcggatctgttctattctccggacggcgaaatgttcgacgtgatggaaaaatacggcgtactgggcgtagagatggaagcggcgggtatctacggcgttgcggctgaatttggcgcgaaagcgctgaccatctgcaccgtgtctgaccatatccgtacccacgagcagaccactgccgctgaacgtcagacgaccttcaacgacatgatcaaaatcgcgctggaatccgtactgctgggcgataaagagtaagattgtgctgtgcccggtggcgcttcgcttaccgggcctacaacggcctgcgattgttacaggatcgatttgtaggctggataaggcgtagccgccatccggcaatctgctgtttatactgcgagcctcattcccgaattaccctctccgcattgccttttgctattaacccgttacgtttggattttgtttaaggaatgaacaaaatgtcgaactatcgtcgttattacattaacggtggaacctggtttttcacggttaatctgaaaaaccggaaaagtgatttacttgtccgccagattgcggaattacgctctgcgattcgccgagtgaaaaatacgaagccttttcaaattgatgcttttgtcgtgttgcctgagcatctgcattgcatctggacgcttcctgagaacgattgtgacttttcatctcgctggcgggagcttaaaaagttatttaccaaatcgataatgcgccatgacgtgtggcagccacgattctgggagcacacgattcgcgacgaaaaggattttcgccgacatgtcgattacctctacttcaaccccgtgaagcacggttgggtaaggcgggtgcaggattggccgttttcgacctttcatcgtgatgttcgcaatggcgtttacccggttgattgggcgggggaggtgagggatcttgacgctggtgaatagcggtaatgccggatggcgcgttgcttatccggcctacagaaagcactcatttgtaggccggataaggcgtagccgccatccggcaattctttaacgcacggcccctgcgacccaattcgccagttcccgcaactcactctcctgttccggaaacgtcgctatcagcgcttcgcacgtttcctgtagtttatccgcccgatactggcagccttgcagccgccccgccagcgcttccagcggtgccgggttcaggctatcggtaaacgcctgtgcgcgagtaatcacacctttctctacgtcaaaatgcagctcgacgccgccccaggtgaaacgctcgtccagcagatggctgaacgccggtgcctggccgaaattccactcccaactgctctggcgcgcaaaggtttcggtaaaattcggcagatccggcgttttatccggtgaaatcacttccgcgtcgatgcgttcgccgtaatgggcgaaaaaggcttccgtgaccgcctggcagacctgttcatgggtgatacccggtaataactcggtaagattggctacgcgggagcgaacggaggtgattcctttcgccgcaagtttctttttatccggattcagatagtttgccagacggctgaggtcggcgttcagcagcagcgtaccgtgatggaagccgcgatctttggtttcgcgataggctgaaccggagactttgcgatcgccgtccggcgtttttacgaccagatcgttgcgtcctgaagcatcggccatgacgcccagcgaattcagcgccgcgagcacaatatgggtggagatggttttatcgtattccggtttaccggccataaaggtaaagcaggtattaccgaggtcatggaataccgcgccgccgccactgctacggcgggccagacggacgttatcttcttccatacgccgcgtattacactctttccacgggttttgcgcgcgtccaatgaccaccgtgtccgcgttgcgccacaggaacagcacgcgctgggtggcgggcatctggcggaaaatgcactcctcgaccgccaggttaaaccagggatcgtaagagtcagaaataagcaggcgtaatgttgtcatggtggttttccttacctttattaagccgtcattttactctttttcctcacgctcttcctcttccggaacaggcttgctggccgttaacaggaagggtgactgctgccagcgggtgcgtttaccttgtagcaaggtgcgcgtcagcaccacgcctatcgccagcgagagtagcagcatcaggcgtagaatgttggtggtgttatcgacctgttttgcttcggtggccagagtgtgggtatccagcgtcagacgcaggtagcccaatgggccgtttttcccctggataggctcgacaatttgttggttaaaatagctgcccgcttttttgccatccagcgccagcctgtcgcgcacgttgacgctttcgccagcgcgagtaataagatcgccctgttcatcatagacgccggcatccagaatacggctctcttgcgtgagctgacgcagcacggcgttgatgcgattttcatccggtgtttcgctgcgcatcagcggggcgatgttgagcgtcacctggcgcgccagcgtgcgggccagctcttccagctgtggattgcgctgtcgctggtggttttgactaaaccaggacgcgccctgcatgagcgcgacgagcagtgtgagacagaacaatacaatgactgcacgatgcagccgaaatttcagttttgcgcgagccatattccacctgctgaaaatttgaggcttaatgttgccagaagcgatggttacaaggtagcctcatgcgttattttccgcggggcggttaccggcctgaacgatttacaggagctttaatgcctaacattacctggtgcgatctgcctgaagatgtctctttatggcctggtttgcctctttctttaagcggcgacgaggtgatgcctctggattaccatgcaggccgcagcggttggctgctgtatgggcgcgggctggataagcagcgtttaactcaatatcagaccaaactgggcgcggcaatggtgattgtcgccgcctggtgcgtggaggattatcaggtcattcgtctggcggggtcgctgacgccgcgtgcgacgcggctggcgcatgaggcgcagctggatgtcgcgccgctgggtaaaattccgcatttgcgcacgccggggctgctggtcatggatatggattccacggcgatccagattgagtgtatcgatgaaatcgctaagctggccggtaccggtgagaaggtggctgaagtgacggagcgcgcgatgcgcggcgagcttgattttaccgccagcctgcgcagccgcgtggcgacgctgaaaggcgcggatgccgatattttgcgccaggtgcgcgggaatctgccgctaatgccaggattaacgcagttggtgctaaaactggaagcgctcggctggaaaatcgctatcgcctccggcggcttcactttcttcgccgactatctgcgtgaccagctacgcctgacggcggcggtcgccaatgagctggagatcatggacggtaaatttaccggtcacgttatcggcgatattgtggatgctgagtataaagccaataccttgcttcgtctggcgcaagagcatgacatcccgctggcgcagacggtggcgattggcgacggcgctaacgatctgccaatgatcaaagcggcagggttaggtattgccttccatgccaagccaaaagtaaacgaaaagacggagattacgatccgccacgctgacctgatgggcgtgttttgcattctctccggcagcatgaaccagaaatgattaatctgcccaatggcaaggcgaccgtaggccggataagcgccagcgccatccggcaacagcgttaacgaaagaggtaaaacgtggcaaaagctcccaaacgcgcctttgtttgtaatgaatgtggtgccgattacccacgctggcaggggcagtgcagcgcctgccaggcctggaacaccattactgaggtgcgccttgccgcgtcgccgacggtggcgcgtaacgaacgtctgagcggatacgccggcagtgcgggcgtatcaaaagtgcagaaactgtctgacatcagtcttgaggaactgccgcgcttttctaccggttttaaagagtttgaccgcgtgctgggcggcggggtggtacccggcagcgccattttgattggcggtaaccccggcgcgggcaaatcaacgttgctgctgcaaacgctgtgcaaacttgccgagcagatgaaaacgctgtacgtcaccggcgaagagtcgctacagcaggtggcgatgcgcgcgcaccgtctcggcctgccgaccgctaatctgaatatgctctccgaaaccagcatcgagcagatctgcctgatagcggaagaagaacagccgaagctaatggtgatcgactccatacaggtgatgcatatggcggacatccagtcgtcgccgggcagcgtcgcccaggtccgcgaaacggcagcctacctgacgcgcttcgctaaaacgcgcggcgtggcgatcgtgatggtcggccacgtcaccaaagacgggtcgctggcggggccgaaagtgctggaacactgtattgattgctcagtattgctcgacggcgacgccgattctcgtttccgcacgctgcgcagccacaaaaaccgctttggcgcagtcaatgagctgggcgtcttcgctatgaccgaacaggggttgcgcgaagtgagcaatccgtccgccatctttttaagccgcggcgatgaggtcacttccggcagctcagtgatggtcgtctgggaaggtacgcgaccgttgctggtggagattcaggcactggtcgatcactcgatgatggcgaaccccagacgcgtggcggtcggtctggaacaaaaccgtctggctatcctgctggcggtgctgcaccgacacggcggtctgcaaatgtcggatcaggacgtcttcgtcaacgtggtcggcggcgtgaaagtcaccgaaaccagcgcggatctggctttactgctggcgatggtctccagcctgcgtgacaggccgttgccgcaggatctggtggtgtttggcgaagtggggctggcaggcgagattcgtccggtgccgagcgggcaggagcgtatttccgaggcggcgaaacacggttttcgtcgggcgattgtgcctgccgccaacgtaccgaaaaagccgccggaaggaatgcaggtgttcggtgttaaaaagctcgcagatgcgttaagcgtgtttgacgacttataattctctgtatgtagtgatgttgtataatttgccggatggcgacgcaatgcgtcttatccggcctacggattgatacggattgatgttgtaggcctgataagcgaagcgccgtcaggcagtgttatgcgatttttccagcaggaggctcttgtgtcatcgttcgactatctcaaaaccgcgattaagcagcaaggttgcactctgcaacaggtggctgacgccagcggtatgaccaaggggtatctgagtcagttacttaacgccaaaatcaaaagccccagcgcgcaaaaactggaggcgctacaccgttttctcgggctggagtttccccgccgacagaaaaacattggcgtggtgttcggtaaattttatccattgcataccgggcacatctacttgatccagcgtgcctgtagccaggtggatgagttgcacatcattatgggatatgacgatacgcgcgaccgcgggctgtttgaagatagcgccatgtcgcagcagcccaccgtgtcggatcgcctgcgctggttgctgcaaaccttcaaataccaaaaaaatattcgcatccacgcctttaatgaagaggggatggaaccttatccgcatggctgggacgtctggagcaacggcattaaagcgtttatggcagagaagggaatacagccgagctggatctacacttccgaagaggctgatgcgccgcagtacctggagcatttagggattgagacggtgctggtcgatcctgaacgcacgtttatgaatatcagcggggcgcaaatccgcgaaaatccgtttcgttactgggaatatattcctaccgaagtgaagccgtttttcgtgcgtaccgtcgcgattctgggcggggaatcaagcggcaagtctacgctggtcaataagctcgccaatatttttaataccaccagcgcctgggaatatggccgcgactatgtcttttcgcatctgggcggcgatgagatggcgttacagtattccgactacgataaaattgcgctgggtcatgcgcaatatattgattttgcagtgaaatatgcgaataaagtagcgtttatcgataccgatttcgtcaccacccaggcattttgcaaaaaatacgaagggcgcgagcatccgtttgtccaggcgctgatcgacgagtatcgcttcgacctggtgattttgctggagaataatacgccgtggatagctgacggactgcgaagcctgggcagttcagtggatcgcaaagcgttccagaacctgctggtcgagatgctgaaagaaaacaacattgagttcgttcacgttaaagaggctgattacgatggccgctttttgcgctgtgtggaactggtgaaagagatgatgggcgagcagggataagaaccaatgcctgatgcgacgcttaccgcgtcttatcaggcctacagtttcacaacgtattggaatcgctgggtttgtaggccgggtaagcgcaagcgccacccggcattcagacgtttatttggcaatacgcttgtacttgatacgcttcggctccagcgcctcggcgcccagagtgcgtttcttgtactcttcgtattcggtaaagttaccttcgaagaattccaccttaccttcatcctgataatccagaatgtgggtggcgatacggtcaaggaaccaacggtcgtgcgagataaccatcgcgcagccagggaactccagcagggcgttttccagcgcgcgcagggtttcgatatccaggtcgttcgtcggttcgtcgagcagcaggacgttgccgcccacctgcagcagcttcgccagatgcaaacgaccacgctcaccgccggacaattcgccaacgcgtttgccctgatcgacgcctttgaagttaaagcggcctacataggcgcggcttggcatttcggtgttgccgatcttcatgatatccagcccgccggacacctcttcccagacggttttgctgttgtccatcgcgtcgcggaactgatcgaccgaggccagcttgacggtttcacccagcgtaatggtgccgctatcaggctgctcctgaccggacatcatgcggaacagggtcgatttacccacgccgtttggcccgatgatcccgacgatagcgcctttcggtaccgagaagctcaggtcgtcgatcagtacgcggtcgccgtaggatttacgcaggttgctgacttcaatgactttgtcgcccagacgcggtcctggtggaataaacagttcgttggtttcgttacgtttctgatactcaacgctgttcagttcttcaaagcgagccagacgcgccttacctttcgactgacggcctttcgcgccctgacgcacccactccagctctttctcaatggatttacggcgcgccgcttcggcagacgcttcctgcgccagacgctgatctttctgctccagccaggaggagtagttgccttcccacggaataccttcgccgcggtcaagctccagaatccagccggcgacgttatcgaggaagtaacggtcgtgggtaatcgccacgacggtgccttcgaagtcgtgcaggaaacgttccagccacgcaacagattcggcatccaggtggttggtgggttcgtcgagcagcagcatgtccggcttttccagcaacagacggcacagcgccacgcggcggcgctcgccgccggacagtttttcgactttggcatcccagtccggcagacgcagggcgtcagcagcacgctcaagctgcacgttcaggttatgaccgtcgtgcgcctggataatctcttcaagccggccctgctctgcggccagcttgtcgaagtcggcatccggatcggcgtacagcgcgtacacttcatccagacgtttgagggcgttaaccacttccgaaacggcctcttcaatcgactcgcgtaccgtgtgttccgggtttagctgaggttcctgcggcaggtagccaatcttaatgccgggctgcgggcgcgcttcgccctcgatatctttatcgagacccgccatgatgcgcagcagggtagacttaccggcgccgttaaggcccagcacgccgattttggcgccagggaagaagctcagcgagatgtttttcagaatatgacgtttcggcggaaccactttgccgacacgatgcatggtataaacgaattgagccacgttggacttcgcctctatgtttatcgtgatggtgaatagatttcaaaggcgaagtgtagcctttttccctgcctaagcccagccagcagatcgcactcgcaataaaagtaaaaaagtgtccgtaacgtggcgcaaatggctatgactggttagcataaattcattacgcggcatgatgctgcattggataacaattgaggaagtgcttgtggatagagccaaaccatttgtctggcgtctcgtcgccgccagcgtatgcctgttgaccttttgtcacctcgcgcgggccgactcactggaagagcagcgtaaccgctatgcgcagattaagcaggcctgggacaaccgccagatggatgtggtagagcagatgatgccgggtctgaaagattatccgctctacccgtatctggaataccgtaagatcaccgacgatttgatgaaccaaccggcgattgccgtcacgcagtttgtgcgcgccaatcctacgcttccgcctgcgcgtacgctgcaatcgcgcttcgtcaatgagctggcgcgtcgtgaagactggcgcggcttgctggcgtttagcccggagaaacccggcaccacggaagcgcaatgtaactattactacgcgaaatggagtaccgggcaaacggaagcggcctggcagggcgcgaaagacctttggctgaccggcaaaagtcagccgaatgcctgcgataaactgttcagcgtctggcgggcctccggcaagcaagacccgctggcgtatctggaacgtattcggctggcgatgaaagccggaaatacggggctggttacggtgctggccggacagatgccggcggaatatcaaacgatcgcctcagcgatcattaccctcgctaatgaccctaataacgtgttgacctttgcacgcaccaccggcgccaccgattttacccgccagatggcggaagtcgcgtttgccagcgtcgcccgccaggacgcggaaaatgcgcgtctgatgatcccctcgctggtacaggcgcagaaacttaatgaggaacaaacgcaggcgctgcgcgatatcgttgcctggcgactgatgggcaacgatgtgaccgatgcgcaggcgaaatggcgcgatgacgcgattatgcgctcgcaatcgacgtcgcttatcgagcggcgcgtgcgtatggcgctggggatgggcgatcgtcgcggtctcaatacctggcttgcccgcctgccgatggaggcgaaagagaaagacgagtggcgttactggcaggcggatttattgctggagcgcggtcgtgacgccgaagcgaaagagatccttcatgctttaatgcagaagcgcggtttttatccgatggtcgcggcgcagcgtttaggcgaagagtacacgcttaaaatcgataaagcgcccgccaacgtaaacagcgcgttgacgcaggggccggagatggcgcgtgtacgggagctgatgtactggaacctggataacacggcgcgcagcgaatgggcgaatctggtaaaaagccgtagtaaatctgaacaggcgcagctggcgcgctatgcgtttaaccagcactggtgggatctgagcgtacaggcgacgatcgccggaaaactgtgggatcatctggaggagcgtttcccgctggcgtataacgatctttttacccgctatacccgcggaaaagatatctcacaaagctatgccatggcgattgcccgccaggagagcgcctggaacccgaaagtaaaatcaccggtaggggccagcggtttaatgcagattatgccgggaacggccacccatacggtgaaaatgttttcgattccggactaccgcggccccggccaactgctggagccggagaccaacatcaacattggcaccagctatttgcagtatgtctatcagcagtttggtaataaccgcatttttgcatcggcggcgtataacgccgggccgggacgcgtgcgcacctggcttggcaatagcgccgggcgtatcgatgccgtagcgtttgtcgaaagcattcccttttcggaaacgcgcggctacgtgaaaaacgttctggcctatgacgcttactatcgccactttatgggacagaaagaggccttaatgagcgactctgagtggcagcgacggtattaatgcagacgggttatgttatcatttgtactcgtgtaacagtacaaacggcggtataacatgacccagcattccccttattcatcggctatcgccgaacaacgtaatcaggagtggcttcgttttgtggagttactccgtcaggcatatgcagaggatctgcatctgcctttattacaactgatgcttacgccggacgagcgtgaagcgctgggaacgcgcgtgcgcattattgaggagttgctgcgtggcgaaatgagccagcgcgagttgaaaaccgagctgggggcgggcatcgctaccatcacacgcgggtcaaacagcctgaaatccgcgccggttgaactgcgtcattggcttgagcagatactgctgaaaagcgcctgatttgctcgtaggccggataagacgaagcggccatccggcaacatcgccgcgaaatgcctgatggcgctgtgcttatcaggcctacaacatagcgcaaataattatcgatacaccgcgttatgaaacgggctgagcgccaggatcaccgcctggtagtaaacgctggagcgcgttaattttccggcggtaaatacgccaatggcgccctctttgcgaccaatccagaaatcagcttgtggatgcaggcgtcgcgcattacccacgcgatttcgtgcgccagcacgcgtttcctcgcttccgaagggctgctccggtacgccgctctcgacggcgacgggtgtaatatggcacgatccttcgccgaaaatctcttcaaatgcctgtagaattgcctgaattttggcaggattggtggtcgcagagataacctggtgcataattaagctcagttttaaaaatttatcgcagtataacggaaaaaaacatgttacaggtataccttgttcgccacggtgaaacgcagtggaacgccgagcgacgtattcagggccaatcggacagtcccctgacggcaaaaggagagcagcaggccatgcaggtaggagaacgcgcccgcagcctcggcatcacccatatcatcagcagcgatttaggccgcacaaaacgcacggcggagattatcgcccaggcgtgcgggtgtgatattacctttgacttccgcctgcgcgagctggatatgggcgtgctggaaaagcgccagatcgattcgctgacggaagaagaagagggctggcgtcgtcagctggtcaacggcacgcaggatggccgcattcctggtggggaatcgatgcaggagttgagcgatcgcgttcatgccgcgctggcgtcctgtctggagctaccgcagggcagccgacctttattggtcagtcacggtatcgcgttgggctgtctggtcagtactatcctgggactacccgcctgggcggaacgccggttacgtttgcgcaactgctctatttcccgtatcgattaccaggaaagtcagtggctggcgtctggctgggtggtagaaaccgcaggggacgtttcgcatctggacacccctgcattggatgagctacagcgttaacggcgaatcgggatcagaaattcgcagcgcaggttgatagggcgatcgccggttttggtatcttctgacgggtagtatcgctctatatcctgccctttacgacgggtcagattcagcattggcatacaggtgccgtaaacggtcaggataaaatcctgcacgccggttcctaacccttcataggtgaacatgacgtattcacctccctgcaacagcacgggatgcgccgactgaacatagccatcggcctgctcttgcggcagtgcggtggtatagaatacttcctgctcatcgtctttctccatgctggggcgcgtttcattaagcccataaagcactggtggaatagttggcgaatgaccgaggaaatcatgccagaattgcacgcgcatttcgtggcggaagtcggaaatctgttccagcgagcaggaatagctctgcgtgacgccaagcagcggcgtatcttccagcgtaacgaactgatgttccggcacggtaaactcgcccagccgtaatggcgggcgaatgccaaaggcgctccattccggggagcgacgatacaacgctggcgtctgggaaaactgtttcttaaaggcgcgcgtaaaggtttgctgagaatcgaagcggtactgaagagcaatatccagaattggacgcgcggttaaacgcagcgccactgctgatttcgataaacgacgggcgcggatataagcgccaatagcgtggcccgtcacgtccttaaacattctctgtaggtgccacttggaatagcctgcttttgccgccacattgtcaagtgacagcggctgatccagatgaccttccagccagattaacaggtcgcgaattatgccagcctgatccataaaatatccccatcctttcaacaacgagcacccgatatcaggtaagaggataatagcattttttgttcttttagcattcagtgttttttttgagcttaaatgctttttttaggcaacgtgacaggtaattattctaatcctgtgatctataaccattttattttagaatgtctaataattacgcaacgtagcttttatgaatggtaacaatatgaaatacaagagcttagtacttttctcaattttgttgctgctggggcagagcgcccgcgcggaacaaattggttcagtcgatacggtatttaaaatgttcggccctgaccataaaatcgtggtggaagcttttgacgatcctgatgtcaaaaacgtgacgtgctatgttagccgggcgaaaacgggcggcataaaaggcggattggggctggcggaagatacgtctgacgccgctatctcttgtcagcaggtcgggcctattgaactgagcgacaaaattaagaacggcaaggcgcagggagaggtggttttcaaaaaacgcacctcattgatatttaagtcattacaggtcgtacgtttctatgatgagaaacgcaacacgctggcgtatctggcctactccgacaaagtggtcgacgggtcgccgaagaacgccatcagcgcggtgccggtcatgccgtggcgacaataacagggaaagcgtatgcagcaaccgcaggtctggttagtcgaggatgaacagggaatcgccgatacgctcatctacaccctgcaactggaagggtttaccgttgagctattcgctcgcgggctgcccgcgctggaaaaagcgcgtcagcaacggccagatgcggtgattctcgatgtgggactaccggatatcagcggctttgagctgtgtcggcagttgctggagcgtcatccggcgctgccgattcttttcctgactgcccgtagcgatgaagtggatcgattgcttggtctggagatcggcgcagatgattatgtcgccaagccgttctcgccgcgcgaagtgagcgcccgcgtgcgcacgctgctgcgccgggtgaaaaagtttgctgcgccgtcgccggtggtgcgtaccggacattttgatctcaatgaaccggcggcgcagatcgcctggtttggtacgccgctctcgctgacgcgttatgagtttctgctccttaaaaccctgctgctgtcgccggagcgcgtgtactcgtgccagcaattgatggatattgtctggtctgatgcccaagagaccttcgatcggacggtcgatacgcacatcaaaaccctgcgcgctaaactacgcgcgatcaacccggatctctcgccaattaacacgcatcgtggaatgggatacagcctgaggagcatctgatgcgcatcggaatgcgtttgctgctgggctactttcttattgtcgccgtcgccgccgtgtttgtgctgtctatctttgttcaggagataaagccgggcgtccgccgcgcgacggaagggacgctgattgacaccgcgacgctgctggcggcgctggcccgcgacgatctcctttccggcaacccgactgacggccagttggcgaaagcattcgcccagctgcaacatcgcccgtttcgcgccaatatcagcgggatcgtcaaagtgcgtaatgaataccatgtctacatgacggatgcgcaggggaaggtgttgtttgattcggaaaacaaagcggtggggcaggattattctcgctggaatgacgtctggcttacgttgcgcggacagtatggcgcccgcagcacggcaaaagattctgccgatcccaatagcaccgtgatgtacgtagccgcgccgataatcagcgatggacggatcatcggcgtcctgactgtcggcaaaccgaatgcggcaatggcgccggtgattaagcgcagcgaacggcgcattctgtgggccagcgccgttttactgggaattgcgctggcgattggcgcggggatggtctggtggattaaccgctccatcgcccggttgacgcgctatgcggattccgtcaccgaaaaccgcccgcttgcgttacctgcattaggcagcagcgagctgcgtaaactggcgcaggcgctggagagtatgcgcattaagctggaaggcaagaatgacattgagcagtacgtgtatgcgttgactcatgagctgaaaagtccgctggcggcgatacgcggcgcggcggagattctgcgtgaaggaccgcccgcggatgtggttacccgctttacagagaatatactggcgcaaaatacgcgaatgcaggcgctggtagaaaccctgctgcgccaggcgcggctggaaaaccgacaggatatccctctcgcgccggttgctgttgatgagctatttacgcagcttagcgaggcgcgcagtattcagttggcggcaaaaaagatcacgcttactctacgtccttcctcgctggttgtcgtcgccgacgcggagcttctggcgcaggcgctgggcaatgtgttggacaatgccatcgactttatgcctgaaaatggcgttatcacattaagcgctcagccgatgggagagaaagcgatcctgcaggtgacggattccggctgtggtattcctgattttgcgctgccgcgcattttcgaccgattctattcgttgccccgtgaaaacgggcgtaaaagcagcgggcttgggctggcgtttgtcagcgaggcggcgcggctcctcaacggtgaggtgacgttgtgcaaccgtcccgaaggcggcgtgctggcctcgttgacacttcaccgtcacttcacataacttcaaattctccccacatcgcgttcttacactgctggcattgcaaaggagaacgctatgttgaaatcccccctgttgtggaaaatgattacgttaggcggcgccatgatcctgctgttaattcccctgatgatggtacggcacaccatcgtggagcgtgctgattatcgaagccatgtagaagccgctattcgtcagagtaccagcggcccgcaaaaggttgtcggcccgctggtggcggttccggtgacagagctctataccgtgctggaagaggagaaagaggttcagtataagcgcagctatctctatttttggctgccggagtcgctattggtcgaaggcaatcaaaacgttgaagcgcgaaaaataggtatttatcaggggcaggtgtggcataccgatatggcgataaaggcagagtttgatgtggcccgtctgcatgagctgaacagaccgaatattacccttggaaagccctttatcgtcgtgggcgtcggcgatgcgcgcggtatcagcgcagtaaaagcgccgcaggtgaatggtgaaatgctcactgtagaaccggggaccggcttaccggaaagtagagagggcattcatatcccgctaccggacagtcagtgggcgacgcgcaacctgacgttggcgatgtcgttaaatttaagcggaaccggcagcttttcactggttcctgtcgggcgtagcagtgaaatgaccctgaccagtaactggccgcacccaaattttgtgggggattttcttcccggtaaacgcgaaatcagcggttcaggatttcaggctcagtggcaaaccagccggtttgccacgaatctcggcgaacagtttgctgatgcgcaaaaggtggattgggacaacttaccggcgtttagcgtcgctgtatcgacgccagccgatcagtatcaactgacggacagagcgacgaaatatgccattttgttgattacgctaacgtttatggctttctttgtcttcgaaaccctgacgggacagcgattacacccgatgcagtatctgctggtagggttatcgctggtgatgttctacctgctgttgctggcactgtcggaacatatcggtttcacgccagcctggatcgccgcaagcctagtgggcgcgttgatgaatagcgtttatttgcaggcggtactgaaaggatggcgcaatagcgtgctgtttacgttagcgttattggcgctggatggcgtgatgtgggggttactgcgttcggaagatagctcgttgcttctgggtaccggcgttctgctactggcgcttggcggcgtgatgttcctgacgcgccatctggactggtattcgctctcttgtcagcaacgtaagtcattaccgccagtaaaagatgacgaattacgtttgtggaaataaatctaacgggcgcgcgcgttaacgttttcccgcgcagcgccagaaaatgtgatgccgtcagttataggtcaggtttaatgttgccgtggcattcgcttgcccggccgttaccgtggcggcggttttatagtagcgcgcgctaattttcagggtggtcgacatattcatggttccgccgttaaccgtctggctgccatcggcattggtggtaatcgtgtgagtaaagagatcaattttttgattgattggcaaactgtcggtaaagaaaccagagtccggcgcctgaatacccaactgtacgccaacgccggttgcgctggttggcgcgcttgcattgctcaactggatgactgaattatcagggttatttccgctggccggttgggcgcttaacgatgcggagatagcggtgccttgttcgcaggtcaataagatatcctgcttgcctgtgcccgcggtttgactgttagcgaaactgcctaaattgacgctgcctaaatcaacggtgatggcaggtgtttctacccgacatcccatcgctttcatgatcaattgcgtattacccaaatacagatgggtcaggatatcgccgccagagctttccgttgcgctatcgcgaaaggatacacgtgccagtgggctttggaatgtcgcggtaccggaggtgatcggaccgcctaaggcgaccagttcaacattgtaggcgggggccatcgcatggtgggttttattgccatcgccattatggtacgtattatcgattggcatgacattatcgtaagggccagcattcgtttgggttttaatcgcaatgcccacgccggaaatcccggtgctaaataccggcgtgttgttcccgtcattcgcattgattgtcgcggatgtatttgactgcgcgctaccgggttcatataaaaaccgaccttataatcgcgactacagccatccattgtgacttcggaggtggaaacccagcccgattgccacaacacttcgcctgcggtataggcgtggctatccaccacaagctgcgacggcggggtgatagtgatcgcgccttcattaccggaacgtttacaggaggcgtaactatgaccggaatacgcgaacagcagaataagcgccagatataaccttctcatgaaaaattcctgcttttatatcaggtgaaatagaaaaatattattgccatgcgatagtgatcgtcacaacggacgtgaaatcccctgccgtgacttttccatacggggtatacatccttgcggcgacaggcaaattggcttcatgggtattactgttgatatccaccgtgtaagtgacgttattggccagattaaccagacttttactgtccaggttaaaaagctgtaatcctaaatcctgcgccggattggccgcgctgtttgcgtaaatcgcagaagcataattcggatcgggataaggtacgccgttaaatgaaatcgcggcttttgtggtcgttgccgggcaattcgtcatttttatggtgaaaggaatggtggcggtattgccaccggccacagcgatatccgcccgggcatattgcccaagagagatcgtgtcaggtaccgtcacggtacacggatcggcataaattaatcccgtaacgttaatgtctacggcatctgcggtattgtatgccgcgctgatcgagggcgaccatgatgccagacccgtgaacgttaacagggcggctaatgcagcaaatctgttcatattcatcttttatcccaccagaatcactggcattgctcgtgtaagatttctacgccagaagcggagggggagctcggtatacgataagagacctgacaccggtctgctgctgttggcccccacttcactaataaccgcccttgtttttccagtccggttaaccaggcttgccccgcatcaccaacaaaactgctgtgattgtctggttttgttaaagacgagacggtcgcgccaaaaggaacaggcagattgtttatgcgggttaataccatcaatgccttgtagccaatattggttttatattcagccctgaccaccgcgccacgggtaggcaccagcgttttactggtatcaatgagctcaatattttttctaatgcctgtcgtatctaaagacacttcattacgatgataaggcgaagcattaggtacgacggcataaccccgaaaatcggtgtccacgcccgtttcgttattcacggggacacctgctgcgccaggggctttaaccaatatgatagtgtcgtccattggctgggatagtgtcaggccatttcgatgtagcagtacgccgccctgaacgccataattcaggcgacgcatatgattatcgtaactatacccgccgttaatatccgcatacgtcccgttataggttgcgctcacattaccgctggtggctttctcttgagaggaataaccttcctgaacgctccatgagagatttttctgtgccagcgctgtgccgtttaaaccgacagtatgcgtgatatcgccgtctttcgcggagttcatattgtaggtggcatacgttgacggcataaaggcatctaacggaatactaatattgattgaaatttgctggtcattactgtcttccgtatcgtcgtcttcatcctgagtattatcggcgttcagcgtataagaatagttaatgccatagcttacgttatgccatgtgttgttatagccaatacctaatgatgtggtatgagtgtcattccagtaatcttcattatataaagtgagtgaaatggaaccgtagataatgtcttgcgacaacgacaggtcggtgcgattgcggacatgatcatagtgactattatcgctataggtatccagcacatcctcaagagcgtagtaatctttggtcgaataacggtaaccggcgacagtaaaattggtgcctgttgactgaatatctttgctgtaacgaatacgccaggactgtccggtaagcgtatcgctaaccacatcgcctgctttaatttttgaccatgagttggtgacgtctaaagacaatgcgcccagatcgccaaggtttaagcctgtcccgatgagcgccgcatgataaacatcattgctcagcgtactctctattccgccataggcggttacgccgcctgctaatccgtataaggccgtcagttctgcgaaattctgttgcgcggaatgcgtatctgatgaacgcgtgcggcctaccgtcaagtcgtatttcaggtggccttcacgctgtaataccggaacgctggcgtagggcacaatgaaatgctgttcagaaccatcggattctttgatggtgacgtacagatcgcccgaaccgccggttggataaagatcgttgatggcgaatgggcccgccggaacgttagttttgtagatggtataaccgttttgttcaacggttacctgcgcgctgcttttggccaccccgcgaatgaccggggcgaaccctttcatactgtccggcaacatatcgtcatcagaagagatctgtacgcccttaaatgaaatactgtcaaagacgtctgcgggcgtgttattttccccggcgatcagctgtccttttaaaaattcgatatcgcgagaaacataggtgtaggcagaatcccagctattttgcccatcgctatcatgattccaggttgagtagttacgaaaacgccatgcgccaatgttaataccagggcgcaggttagcgtattcgctattttccgtccggttttcatcaatatcgtgatcctgcgatccggtaaaactgtagttcagcaaaaaagcattaatgccttcatcccatttgctggtagggacgaattctcgcgggtcggcgatcaacgcgatttgagggatcgctaaatccagccggttaccgatgacattaaactttgctacagcgccagccagcagactaagatcggtacacccgtttgggtcatttttaagctcggggaagttttctgtttttacgccccactgcttgagttgttcaacgctaagacatggctgtagggagagcttattatctgctgattttttatttttaaaggcaatattttttgtttcaacattagtgttattaatataaatatcaacattataggtgccttctgcctgccccccttttcgaaaaccgatagatcgacattctccacgcccggttcatcattttccaacgataatggattaaaatgatcatgcgctaacgctggttttatggatcagcatataaagagaaacgataacgctaattgagaacggggctctactctggagaattgcacagtaaaagtcctgaaagggtaaaagtaaagtgaagtcgttaatggctagaatgaaccggaatgcggctctaaactcatcccataatcgctgattaatcgccacgttaccgtaccatgaggggcggcagtcgaactcaatttaaatgacgctgatgattttggcggaacgaaggtcgctgatttcacttcatggctgttaagcgtcacactggcaaagttcatataatagggggtagggttatttacggtaataacatcccctgccgtctgccattttaattgttggctctggctatcaggcgttgatttggttaatgctggcggtcgataaataagctttatttgggtattaatggagatttccacgcggttcgcggaggcattatcatcaatagaaggaatacccttaatattgagccagtacatagactcccgatctgcaggtagaggggcgccagagcgaataacccgaatactgttcttttgcccggcatcaaggcgaaaaagaggcggggtgataataaacacctgcttatttgtgacctggggatcggcaaccgataaccatgactgaacaagattcgctttgctgtctttattctctacattgattgacgactcatcattattgccgtcgaaaaccagtcgggttccgccaacaacaatgctggcatgggcaacatggcttgtcagtaatacgaccaacacggatttctttatgtgtttcattttttactctgtaaagatgttttacgctatggactggcatcctgcctgtccacatcaggatgagaatgccttactgatacgaaacggtatacgtaacctgagtgctaacatctccaccggttacggttgcggaaccatcgtttgccatggcggcgtaataggtaaagtctgctgtcgagccgtcggttggcaggcttactgcggcatcatccgtgttatctgtcacatcgctatgtgaagcgttctgaatagaaataccgacacccgcggcgcccgtttccgatccttcgtccgcgtttttgaagtacgttgggttggaatcatctgttgcgccgtggaagcggaacatggcctgggtcggtacgccagtccctgcttccgggcagctaaccaggcttacggtaaacggcacgtaatcggttgtggcgcctttttccgcgatgcgttctttgctgtaattacctaaatcaatggtggtatccgtggagccattaacctgaaccgtacacgcctgatcgtaaattttgccattgaacgtaatcgtgttctgggcaaataccggtgtggatgctacggcagttaacattgccaggatgataattttcttattaaacatattaattgttgcctgattctattcgctgaaaaataaagatagctatataaaataaaatattatattttactctgtatgcgcttctttctgttctgtagataagcaggcggctattctacgtatatcaactatgaactcaataaaaattctgatgcaatattgaacggcagtccagtttcggacccggtaacaaagtttaataaaataccactaaagaagtacggtagatgactggatttatagagcaagatctcttttttgataatagttattatttcctggaggatttatttaactctatattgctttatttttaataatatacgacgcttgttcatttaaaatgaaaccggcaggtttcgaagctctaacagtcttccatgcagtatttttatatagttccccgcttttaattctgaaagtacctgcatgatacggctgcgtgaaagcccggttctctgctgtatgaagttctgtgcgttgatctcaaatcgtgagctttcaggatacgaccacagttcaagtaacagcgcttttatctggctataggcgtcctgcccgataaggtttctgtcacggttactcatgaaagcaatgcggtacatcaggatgttcgaaatgtcacgccagagatgcttttcatcggctatttccacaaaatcttttactgggacaggataatattcacaggtggtttcggcgataaaaaagacgtctgaattctcttctaactggtataagtcggcataggcatctacaaggcctaaaatcattggcgagacaccacagcccattacaatactgtcgatacgccgacatactttaatagcgcctttagtgattaacaggatgtgggattgattatcaatcttgatatccagggttttaccggccgtaatagtgacaggggagatgttttgaataacgtgccgatgaatatttaaaatggcttgcaggtttttttctttccctgtgggacgatacacattcccgccgtttaactgcttcatatcttccccattattatggctgataaagtggttgactattaaaaggtaaacataaatttaatattcacttaaattataattaagtaaattaaaatagccaacaagaatatttaagtcaatgtattcaccttatcaatgcatgagcgacaacgctgtttttaaggttaaccatagtaaatgtgatgattttatttgcaatcattttatgacagctatcataggtaccgtgcttaacgagcgcgtagagcgtacaggatagcgaagcgatgaacatcgctgttggaggatacgaatgagagaaaagtacaaaatgcaagcgggcggcgttttactgagcgaaatcgccgcctgccggaactcctcccgtcgggagccataagcggttagcggtactggacgatcaggctttgaatctccggatgatcttttaacgacacgtgccgtaccgtggcgattccattcatcaacgaaatagcgtttccagacggtgtggcgactgtctgcaaatgggggattccgcaaacatgatacctcgatattgcgatcgtgaggcgcaagattacaaccatattcgacaatctggcctttgaaatgaataacgcctgcggagaccggcgcggtagcagccagcgcggctgatgaagctgacatcgctgcacaaaacaggtagcagcataatggtgattttttcatcctgtgaaacctcacgtcctgtgagcatccccttaatttttggggaccaacaaatcccgtgtattactctttaatgtaaatacacaaactaccttaactttcgcaagctgagataaacagcgctatacgacaatttttatgtaaaagagtacgtcataacggcaggtcaggagggaaagcggggccgcttagcggaaggggagcataagaaacagccagtaagaataacttaccggctgtttttacggtttggcgcctgggccgaattaatcctgcaggtcgccgcagaagcgataaccttcgccgtgaatggtggcgatgatttccggcgtatccggcgtggattcgaaatgcttacgaatacgacgaatggtgacgtcaacagtacggtcatgcggcttcagctcgcgtccggtcatttttttcagcagctcggcacgagactgaattttgccagggttttcgcagaagtgcagcatcgcgcggaactcgctgcgcggtagtttatactgctcgccgtccgggccgatcagtgaacggctgttgatatccagttcccaaccgttgaacttatagctttcaacgctacgacgctcttcgctgacggtacccaggttcatggtacgggacagcaggttacgggcacggatggtcaattcgcgtggattaaacggtttggtgatgtaatcatccgcgccgatttcgaggccgagaattttgtcgacttcgttatcgcggcccgtcaggaacatcagcgcaacattagcctgctcacgcagttcacgcgctaacaggagaccgtttttccctggcagattgatatccatgatcaccaggttgatgtcatattcagagaggatctgatgcatttccgcgccatctgtcgcttcgaatacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgtcgcaaattaacatgatcggcgtaacatgactaaagtacgtaattgcgttcttgatgcactttccatcaacgtcaacaacatcattagcttggtcgtgggtactttccctctggacccgacagtgtcaaaaacggctgtcatcctaaccattttaacagcaacataacaggctaagacgtaccggacacctaataaaactacgcttcgttgacatatatcaagttcaattgtagcacgttaacagtttgatgaaatcatcgtagctaaatgctagctttcatcacaaatttgcaatattccaactagttacgtaagccaactaataaatgcgatgaatccaaagaacaggatctattttaaattaaattatcctaaataaacagcaggataacgatgttctgttaacataaacagcaatagtacagatacgcaatagtgtagcgtcttttacgaaatcaaaaatgctttttcagtgatatccgttaaaattttgtaaatttgcgaagcgtaatatgcttacaaacgccagctaatttcctgtaaattagtcaaaaagagtaatgaaatgcgtgtaacaatcgttcttgtcgctcccgccagagcggaaaatatcggcgcagccgcccgggctatgaagaccatgggatttactgacctgcgtattgtcgacagccaggcgcacctagagcccgctacccgttgggtcgcacatggatctggagatattattgataatattgaggttttccacacccttgccgacgcgctccacgatgtggattttaccgtagcgacgacagcccgcagccgggcaaaatttcattactacgcttcgcccgctgaactggttcccttattacaggaaaaatcacgctggatgcgtcatgccgcgctggtttttggccgtgaggattccggtctgaccaacgacgagctggcgctggcggatgtattgaccggcgtgccgatggcggcggattacccttcgctcaatctgggtcaggcggtcatggtgtattgctatcaattagcaggtttaatgcaacagaccccggaatccgttgatattgctgatgaatcgcagttacaggcgttacgcgcgcgccttttacgcctgctaaccactctggaggcggccgatgaccacaaattaaccgactggctacaacagcgaatcggcctgctgggacagcgagatacggcaatgttgcaccgtttggtccatgatattgaaaaaaaactaacaaaataacgtgttgtaatttttaaaataata
